(12) United States Patent
Inoue

(10) Patent No.: US 8,865,426 B2
(45) Date of Patent: Oct. 21, 2014

(54) SCREENING METHOD USING GELATINASE-MEDIATED EPHA4 CLEAVAGE REACTION AS AN INDICATOR

(75) Inventor: Eiji Inoue, Kobe (JP)

(73) Assignee: Eisai R&D Management Co., Ltd., Tokyo (JP)

( * ) Notice: Subject to any disclaimer, the term of this patent is extended or adjusted under 35 U.S.C. 154(b) by 0 days.

(21) Appl. No.: 13/993,126

(22) PCT Filed: Dec. 8, 2011

(86) PCT No.: PCT/JP2011/078460
§ 371 (c)(1), (2), (4) Date: Jun. 11, 2013

(87) PCT Pub. No.: WO2012/081502
PCT Pub. Date: Jun. 21, 2012

(65) Prior Publication Data
US 2013/0288278 A1    Oct. 31, 2013

(30) Foreign Application Priority Data
Dec. 17, 2010    (JP) .................................. 2010-282165

(51) Int. Cl.
*C12Q 1/37*    (2006.01)

(52) U.S. Cl.
USPC ............................. 435/23; 435/7.92; 435/212

(58) Field of Classification Search
USPC .......................................... 435/23, 7.92, 212
IPC ............. C12Q 1/37; G01N 2500/02,2333/9649
See application file for complete search history.

(56) References Cited

U.S. PATENT DOCUMENTS

| | | | |
|---|---|---|---|
| 5,876,946 A | 3/1999 | Burbaum et al. | |
| 5,902,732 A | 5/1999 | Hochman | |
| 7,892,769 B2 | 2/2011 | Inoue et al. | |
| 7,910,324 B2 * | 3/2011 | Inoue | 435/23 |
| 8,137,926 B2 * | 3/2012 | Inoue | 435/23 |
| 8,530,181 B2 * | 9/2013 | Inoue | 435/23 |
| 2002/0068361 A1 | 6/2002 | Clary | |
| 2006/0241074 A1 | 10/2006 | Woolf et al. | |
| 2007/0015145 A1 | 1/2007 | Woolf et al. | |
| 2007/0026409 A1 | 2/2007 | Woolf et al. | |
| 2008/0213250 A1* | 9/2008 | Hopf et al. | 424/130.1 |
| 2009/0023158 A1 | 1/2009 | Shapiro et al. | |
| 2009/0142788 A1 | 6/2009 | Inoue | |
| 2009/0163594 A1 | 6/2009 | Shapiro et al. | |
| 2009/0191580 A1 | 7/2009 | Inoue | |
| 2009/0275049 A1 | 11/2009 | Inoue et al. | |
| 2010/0021950 A1 | 1/2010 | Lammert et al. | |
| 2010/0113415 A1 | 5/2010 | Rajapakse et al. | |
| 2010/0190184 A1 | 7/2010 | Inoue | |
| 2010/0255522 A1 | 10/2010 | Inoue | |
| 2011/0104171 A1 | 5/2011 | Inoue et al. | |
| 2011/0111444 A1 | 5/2011 | Inoue | |

FOREIGN PATENT DOCUMENTS

| | | |
|---|---|---|
| EP | 0351585 A2 | 1/1990 |
| EP | 1514925 A1 | 5/2002 |
| EP | 1662259 | 5/2006 |
| EP | 1693449 A1 | 8/2006 |
| EP | 1947193 A1 | 7/2008 |
| EP | 1815255 | 4/2009 |
| EP | 2 166 110 | 3/2010 |
| EP | 2177623 | 4/2010 |
| EP | 2192181 | 6/2010 |
| EP | 2 223 999 | 9/2010 |
| EP | 2219028 | 9/2012 |
| JP | 2824433 | 9/1998 |
| JP | 2003-169699 A | 6/2003 |
| JP | 3680114 | 5/2005 |
| JP | 2006-508653 | 3/2006 |
| WO | 98/45708 | 10/1998 |
| WO | 03/016475 | 2/2003 |
| WO | 2004/048578 | 6/2004 |
| WO | 2005/045028 | 5/2005 |
| WO | 2005/083086 | 9/2005 |
| WO | 2006/026820 | 3/2006 |
| WO | 2006/056467 | 6/2006 |
| WO | 2006/061660 | 6/2006 |
| WO | 2008/087035 | 7/2008 |
| WO | 2008/150010 | 12/2008 |
| WO | 2009/069808 | 6/2009 |

OTHER PUBLICATIONS

International Search Report for International Patent Application PCT/JP2011/078460 dated Jan. 10, 2012.
Inoue et al., Synaptic activity prompts γ-secretase-mediated cleavage of EphA4 and dendritic spine formation, J. Cell Biol., 185(3):551-564 (2009).
Ethell et al., Matrix Metalloproteinases in Brain Development and Remodelling: Synaptic Functions and Targets, J. Neurosci. Res., 85:2813-2823 (2007).
Landman and Kim, "Got RIP? Presenilin-dependent intramembrane proteolysis in growth factor receptor signaling", Cytokine & Growth Factor Reviews, 15:337-351 (2004).

(Continued)

Primary Examiner — Ralph Gitomer
(74) Attorney, Agent, or Firm — Fish & Richardson P.C.

(57) ABSTRACT

The object of the present invention is to provide a method for screening a substance that affects gelatinase-mediated EphA4 processing. The present invention provides a method for screening a substance that affects gelatinase-mediated EphA4 processing, which comprises the steps of: (a) allowing a first biological composition containing gelatinase or a biologically active fragment thereof to be contacted with a second biological composition containing EphA4 in the presence and absence of a candidate substance; (b) measuring the presence or amount of the EphA4 ectodomain and/or endodomain fragment; and (c) selecting the candidate substance as a substance that affects gelatinase-mediated EphA4 processing if the results of the step (b) measured in the presence of the candidate substance are changed in comparison with the results of the step (b) measured in the absence of the candidate substance.

9 Claims, 1 Drawing Sheet

(56) References Cited

OTHER PUBLICATIONS

Murai et al., "Control of hippocampal dendritic spine morphology through ephrin-A3/EphA4 signaling", Nature Neuroscience 6(2):153-60 (2003).

"Gelatinase," from Dictionary of Molecular Cell Biology (Masami Muramatsu et al. eds., Showado Insatsusho 1997) at 457-458.

Akimoto et al., "Hepatocyte Growth Factor As an Enhancer of NMDA Currents and Synaptic Plasticity in the Hippocampus", Neuroscience; 128(1):155-62 (2004).

Amtul et al., "A Presenilin 1 Mutation Associated with Familial Frontotemporal Dementia Inhibits γ-secretase Cleavage of APP and Notch", Neurobiol. Disease., vol. 9, No. 2, pp. 269-273 (2002).

Aoto, J. and Chen, L., "Bidirectional ephrin/Eph signaling in synaptic functions," Elsevier, Brain Res. (2007) vol. 1184 72-80.

Beg et al., "α2-Chimaerin Is an Essential EphA4 Effector in the Assembly of Neuronal Locomotor Circuits", Neuron 55, 768-778, 2007.

Braak and Braak, "Neuropathological stageing of Alzheimer-related changes, Acta". Neuropathol., 82: 239-259 (1991).

Carter, Chris; "Alzheimer's Disease: APP, Gamma Secretase, APOE, CLU, CRI, PICALM, ABCA7, BINI, CD2AP, CD33, EPHAI, and MS4A2, and Their Relationships with Herpes Simplex, *C. pneumoniae*, Other Suspect Pathogens, and the Immune System", International J of Alzheimer's Disease vol. 2011, pp. 1-34 (2011).

Cheng et al., "γ-Secretase activity is dispensable for mesenchyme to epithelium transition but required for podocyte and proximal tubule formation in developing mouse kidney", Development, vol. 130, No. 20, pp. 5031-5042 (2003).

Communication for EP08765357.2 dated Feb. 4, 2011.

Consultation by telephone for EP08849729 dated Mar. 20, 2012.

Decision of final rejection for JP2009-543902 issued on Aug. 20, 2013 (with English translation).

Dufour et al., "Genetic analysis of EphA-dependent signaling mechanisms controlling topographic mapping in vivo", Development, 133: 4415-4420 (2006).

Eriksen et al, "NSAIDs and enantiomers of flurbiprofen target Y-secretase and lower Aβ42 in vivo", J, Clin, Invest, 112, 440-449 (2003).

European Search Report EP08849729 dated Nov. 26, 2010.

European Search Report EP08765357 dated Jun. 25, 2010.

European Search Report EP08791346 dated Nov. 29, 2010.

European Search Report EP088536263 dated Apr. 4, 2011.

Extended European Search Report for EP08792114.4 dated Nov. 9, 2010.

Final Office Action for U.S. Appl. No. 12/175,595 dated Nov. 8, 2011.

Folstein et al., "Mini-Mental State" A Practical Method for Grading the Cognitive State of Patients for the Clinician, J Psychiatr Res 12: 189-198 (1975).

Foveau et al., "Down-Regulation of the Met Receptor Tyrosine Kinase by Presenilin-Dependent Regulated Intramembrane Proteolysis", Molecular Biology of the Cell, vol. 20, 2495-2507 (2009).

Fox et al., cDNA cloning and tissue distribution of five human EPH-like receptor protein-tyrosine kinase's, Oncogene(1995) vol. 10, No. 5 897-905.

Fraering et al. "γ-Secretase Substrate Selectivity Can Be Modulated Directly via Interaction with a Nucleotide-binding Site", Journal of Biological Chemistry 280(51) 41987-41996 (2005).

Gähwiler, B, H, "*Organotypic cultures of neural tissue*", Trends Neurosci. 11(11): 484-489 (1988).

Galasko et al., "An Inventory to Assess Activities of Daily Living for Clinical Trials in Alzheimer's Disease", Alzheimer Dis Assoc Disord, 11 suppl 2: S33-9 (1997).

Georgakopoulos et al., "Metalloproteinase/Presenilin 1 processing of ephrinB regulates EphB-induced Src phosphorylation and signaling", The EMBO Journal, vol. 25, p. 1242-1252 (2006).

Haapasalo et al, "Presenilin/γ-Secretase-mediated Cleavage Regulates Association of Leukocyte-Common Antigen-related (LAR) Receptor Tyrosine Phosphatase with β-Catenin", J. Biol. Chem, American Society for Biochem, and Molecular Biology Inc.US, vol. 282 No. 12 pp. 9063-9072 (2007).

Hansson et al., "Nicastrin, Presenilin, APH-I, and PEN-2 Form Active γ-Secretase Complexes in Mitochondria", J, Biol. Chem; vol. 279, Issue 49, 51654-51660 (2004).

Hering and Sheng, Dendritic Spines: Structure, Dynamics and Regulation, Nat. Rev. Neurosci. 2(12):880-8 (2001).

Hitoshi et al., "Efficient selection for high-expression transfectants with a novel eukaryotic vector", *Gene.* 108: 193-200 (1991).

Holmberg et al., "Regulation of repulsion versus adhesion by different splice forms of an Eph receptor", Nature, vol. 408, No. 6809, p. 203-206 (2000).

Houston and Banks, "The chemical-biological interface: developments in automated and miniaturised screening technology", Curr Opin. Biotechnol, 8, pp. 734-740 (1997).

International Search Report for PCT/JP2008/060567 dated Aug. 26, 2008.

International Search Report for PCT/JP2008/063037 dated Sep. 9, 2008.

International Search Report for PCT/JP2008/063901 dated Aug. 26, 2008.

International Search Report for PCT/JP2008/070864 dated Jan. 6, 2009.

International Search Report for PCT/JP2008/071831 dated Jan. 27, 2009.

Invitrogen product sheet for "Mouse anti-EphA4 Receptor", Downloaded from web on Apr. 5, 2013.

Jayawickreme and Kost, "Gene expression systems in the development of high-throughput screens", Curr Opin. Biotechnol., 8, pp. 629-634 (1997).

Kaether et al., "Assembly, trafficking and function of gamma-secretase.", Neurodegener Dis. 3(4-5):275-83 (2006).

Kawarabayashi et al., "Age-Dependent Changes in Brain, CSF, and Plasma Amyloid β Protein in the Tg2576 Transgenic Mouse Model of Alzheimer's Disease", J, Neurosci. 21(2), 372-381 (2001).

Khachaturian, Z., "Diagnosis of Alzheimer's Disease", Arch Neuro 42: 1097-1105 (1985).

Koehler and Milstein, "Continuous cultures of fused cells secreting antibody of predefined specificity", Nature, 256, 495 (1975).

Kopan, R. and Ilagan, M. X.., "γ-Secretase: proteasome of the membrane?", Nature Reviews Molecular Cell Biology, 6, vol. 5, p. 499-504 (2004).

Kuure et al., "Crosstalk between Jabbed1 and GDNF/Ret/GFRα1 signalling regulates ureteric budding and branching", Mech, Dev, vol. 122, No. 6, pp. 765-780 (2005).

Lanz et al., "The γ-Secretase Inhibitor N-[N-(3,5-Difluorophenacetyl)-L-alanyl]-S-phenylglycine t-butyl Ester Reduces Aβ Levels in Vivo in Plasma and Cerebrospinal Fluid in Young (Plaque-Free) and Aged (Plaque-Bearing) Tg2576 Mice", Pharmacol. Exp, Ther, vol. 305, No. 3; 864-871 (2003).

Lee et al., "Presenilin-dependent γ-Secretase-like Intramembrane Cleavage of ErbB4*", The Journal of Biological Chemistry, vol. 277, pp. 6318-6323 (2002).

Litterst et al., "Ligand Binding and Calcium Influx Induce Distinct Ectodomain/ γ-Secretase-processing Pathways of EphB2 Receptor", J. Biol Chem, vol. 282, No. 22, pp. 16155-16163 (2007).

Liu et al., "Intramembrane Proteolysis of human NotchdeltaE", Society of Neuroscience, Abstract Viewer and Itinerary Planner, vol. 2003 pp. Abstract No. 729.11 (2003).

Maretzky, Thorsten et al., L1 Is Sequentially Processed by Two Differently Activated Metalloproteases and Presenilin/γ-Secretase and Regulates Neural Cell Adhesion, Cell Migration, and Neurite Outgrowth, Molecular and Cellular Biology, p. 9040-9053 vol. 25, No. 20 (2005).

Martone et al., "Immunolocalization of the receptor tyrosine kinase EphA4 in the adult rat central nervous system", Brain Research, 771: 238-250 (1997).

Maulik et al., "Role of the hepatocyte growth factor receptor, c-Met, in oncogenesis and potential for therapeutic inhibition", Cytokine Growth Factor Rev, 13(1):41-59 (2002).

McKhann et al, Clinical diagnosis of Alzheimer's disease: Report of the NINCDS-ADRDA Work Group* under the auspices of Depart-

(56) References Cited

OTHER PUBLICATIONS ment of Health and Human Services Task Force on Alzheimer's Disease, Neurology 34: 939-944 (1984).
McLendon et al. "Cell-free assays for γ-secretase activity[1]", The FASEB Journal 14: 2383-2386 (2000).
Minopoli et al., "Receptor-and Non-Receptor Tyrosine Kinases Induce Processing of the Amyloid Precursor Protein: Role of the low-Density lipoprotein Receptor-Related Protein", Neurodegener Dis., vol. 4, No. 2-3, pp. 94-100 (2007).
Mirra et al, "Making the Diagnosis of Alzheimer's Disease. A Primer for Practicing Pathologists", Arch Pathol Lab Med 117: 132-144 (1993).
Mirra et al., The Consortium to Establish a Registry for Alzheimer's Disease (CERAD). Part II. Standardization of the neuropathologic assessment of Alzheimer's disease, Neurology 41: 479-486 (1991).
Moehlmann et al. "Presenilin-1 mutations of leucine 166 equally affect the generation of the Notch and APP intracellular domains independent of their effect on $A\beta_{42}$ production", PNAS 99(12): 8025-8030 (2002).
Mohs., *"Comprehensive and Neuropsychologic Evaluations*, The Alzheimer's Disease Assessment Scale", Int Psychogeriatr 8: 195-203 (1996).
Murphy et al., "γ-Secretase, Evidence for Multiple Proteolytic Activities and, Influence of membrane Positioning of, Substrate, on Generation of Amyloid β Peptides of Varying Length", J, Biol Chem, vol. 274, No. 17, p. 11914-11923 (1999).
Nakanishi et al., "ALL1 fusion proteins induce deregulation of *EphA7* and ERK phosphorylation in human acute leukemias", Proc Natl Acad Sci USA, vol. 104, No. 36, p. 14442-14447 (2007).
Nath et al., "Shedding of c-Met is regulated by crosstalk between a G-protein coupled receptor and the IEGF receptor and is mediated by a TIMP-3 sensitive metalloproteinase", Journal of Cell Science, vol. 114, p. 1213-1220 (2001).
Notice of Allowance for U.S. Appl. No. 12/742,312 dated Nov. 5, 2012.
Notice of trial and amendment for JP2009-543902 filed on Nov. 19, 2013 (with English translation).
Office Action (Restriction Requirement) U.S. Appl. No. 12/986,922 dated Jan. 18, 2013.
Office Action EP088497292 dated Apr. 26, 2012.
Office Action EP08853626 dated Nov. 18, 2011.
Office Action EP088536263 dated Oct. 29, 2012.
Office Action for EP088536263 dated Aug. 5, 2013.
Office Action JP2009-517923 dated Jul. 2, 2013 (with English translation).
Office Action U.S. Appl. No. 12/135,307 dated Jun. 10, 2010.
Office Action U.S. Appl. No. 12/175,595 dated Apr. 18, 2012.
Office Action U.S. Appl. No. 12/175,595 dated May 17, 2011.
Office Action U.S. Appl. No. 12/325,418 dated Apr. 1, 2010.
Office Action U.S. Appl. No. 12/670,987 dated Dec. 4, 2005.
Office Action U.S. Appl. No. 12/742,312 dated Jul. 17, 2012.
Office Action U.S. Appl. No. 12/986,922 dated Apr. 10, 2013.
Office Action U.S. Appl. No. 13/009,127 dated Jul. 13, 2011.
Office Action U.S. Appl. No. 13/993,126 dated Feb. 8, 2014.
Office Action (Restriction Requirement) U.S. Appl. No. 12/135,307 dated Mar. 19, 2010.
Office Action (Restriction Requirement) U.S. Appl. No. 12/742,312 dated May 14, 2012.
Office Action (Restriction Requirement) U.S. Appl. No. 12/325,418 dated Nov. 10, 2009.
Office Action for JP2009-541201 issued on Sep. 24, 2013 (with English translation).
Office Action for JP2009-543902 issued Feb. 28, 2012 (with English translation).
Office Action for JP2009-543902 issued Nov. 6, 2012 (with English translation).
Pak et al., "Regulation of Dendritic Spine Morphology by SPAR, a PSD-95-Associated RapGAP", Neuron 31:289-303 (2001).
Pelletier et al., γ-secretase-Dependent Proteolysis of CD44 Promotes Neoplastic Transformation of Rat Fibroblastic Cells, Cancer Res., vol. 66, No. 7, pp. 3681-3687 (2006).
Penzes et al., "Convergent CaMK and RacGEF signals control dendritic structure and function", Trends in Cell Biol. 18(9):405-413 (2008).
Pozner-Moulis et al., "Met, the Hepatocyte Growth Factor Receptor, Localizes to the Nucleus in Cells at Low Density", Cancer Reseatch, vol. 66, pp. 7976-7982 (2006).
Predicted: *Rattus norvegicus* similar to Eph receptor A4 (LOC316539), mRNA; NCBI_Accession No. XM_244186.3.
Ra, H. and Parks, W., "Control of Matrix Metalloproteinase Catalytic Activity", Matrix Biol .26(8): 587-596 (2007).
Ramakers, Ger J.A., "Rho proteins, mental retardation and the cellular basis of cognition", Trends Neurosci. 25(4):191-9 (2002).
Ray et al., "Evidence for a physical interaction between presenilin and Notch", PNAS, vol. 96, No. 6, p. 3263-3268 (1999).
Request for Continued Examination for U.S. Appl. No. 12/742,312 dated Feb. 5, 2013.
Response to Communication for EP08765357.2 dated Jun. 1, 2011.
Response to EP Office Action for EP08792114.4-1223 filed May 26, 2011.
Response to Final Office Action U.S. Appl. No. 12/175,595 Feb. 8, 2012.
Response to Office Action JP2009-543902 dated Apr. 27, 2012 (with English translation).
Response to Office Action JPA2009-543902 dated Dec. 28, 2012 (with English translation).
Response to Office Action EP08765357 filed Jan. 7, 2011.
Response to Office Action EP08791346.3 filed Jun. 21, 2011.
Response to Office Action EP08849729.2-1223 filed Jun. 21, 2011.
Response to Office Action EP08853626.3 dated Dec. 11, 2013.
Response to Office Action EP088536263 dated Mar. 14, 2012.
Response to Office Action EP088536263 dated Dec. 27, 2012.
Response to Office Action EP0885362632405 filed Oct. 21, 2011.
Response to Office Action for JP2009-541201 filed on Nov. 18, 2013 (with English translation).
Response to Office Action JP2009-517923 dated Aug. 29, 2013 (with English translation).
Response to Office Action U.S. Appl. No. 12/135,307 May 6, 2010.
Response to Office Action U.S. Appl. No. 12/135,307 Sep. 2, 2010.
Response to Office Action U.S. Appl. No. 12/175,595 Aug. 18, 2011.
Response to Office Action U.S. Appl. No. 12/325,418 Dec. 10, 2009.
Response to Office Action U.S. Appl. No. 12/325,418 Jul. 21, 2010.
Response to Office Action U.S. Appl. No. 12/742,312 Jun. 11, 2012.
Response to Office Action U.S. Appl. No. 12/742,312 Oct. 16, 2012.
Response to Office Action U.S. Appl. No. 12/986,922 Feb. 4, 2013.
Response to Office Action U.S. Appl. No. 13/009,127 Sep. 28, 2011.
Response to Office Action U.S. Appl. No. 13/993,126 filed Feb. 4, 2014.
Sakaguchi et al., "Sprouting of CA3 pyramidal neurons to the dentate gyrus in rat hippocampal organotypic cultures", Neurosci. Res. 20 :157-164 (1994).
Sambrook, et al., Introduction of Recombinant Vectors into Mammalian Cells, Molecular Cloning 3: 16.30-16.31 (1989).
Sarlola, H. and M. Saama.,"Novel functions and signalling pathways for GDNF", J, Cell. Sci, vol. 116 pp. 3855-3862 (2003).
Sastre et al., "Presenilin-dependent y-secretase processing of β-amyloid precursor protein at a site corresponding to the S3 cleavage of Notch", Embo Reports, vol. 2, No. 9, p. 835-841 (2001).
Saura, et al., "Loss of Presenilin Function Causes Impairments of Memory and Synaptic Plasticity Followed by Age-Dependent Neurodegeneration", Neuron, vol. 42, No. 1, pp. 23-36 (2004).
Shamah et al., "EphA Receptors Regulate Growth Cone Dynamics through the Novel Guanine Nucleotide Exchange Factor Ephexin", Cell, vol. 105, No. 2, p. 233-244 (2001).
Song et al., "Proteolytic release and nuclear translocation of Notch-1 are induced by presenilin-1 and impaired by pathogenic presenilin-1 mutations", PNAS, 96: 6959-6963 (1999).
Stoppini et al., "A simple method for organotypic cultures of nervous tissue", Neurosci. Methods.37: 173-182 (1991).

(56) References Cited

OTHER PUBLICATIONS

Tashiro, A. and Yuste, R. "Regulation of dendritic spine motility and stability by Rac1 and Rho kinase: evidence for two forms of spine motility", Mol Cell Neurosci. 26(3):429-40 (2004).

Tomita et al., "Presenilin-dependent intramembrane cleavage of ephrin-B1", Molecular Neurodegeneration 1:1-9 (2006).

Tremblay et al., "Localization of EphA4 in Axon Terminals and Dendritic Spines of Adult Rat Hippocampus", Neurol 501: 691-702 (2007).

Tyndall, S. and Walikonis, R. "The Receptor Tyrosine Kinase Met and Its Ligand Hepatocyte Growth Factor are Clustered at Excitatory Synapses and Can Enhance Clustering of Synaptic Proteins", Cell Cycle 5(14):1560-1568 (2006).

Vidal et al., "Presenilin-dependent γ-Secretase Processing Regulates Multiple ERBB4/HERA Activities", Journal of Biological Chemistry, vol. 280, No. 20, p. 19777-19783 (2005).

Wajih et al., "Vascular Origin of a Soluble Truncated Form of the Hepatocyte Growth Factor Receptor (c-met)", Circulation Research 90, 46-52 (2002).

Wikipedia, the free encyclopedia, Gamma secretase; Wikipedia Jan. 16, 2012.

Xu et al., "Expression of truncated Sek-1 receptor tyrosine kinase disrupts the segmental restriction of gene expression in the *Xenopus* and zebrafish hindbrain", Development, vol. 121, No. 12, p. 4005-4016 (1995).

Yamaguchi, Y. and Pasquale, E.B., "Eph receptors in the adult brain", Current Opinion Neurobiology, 14:288-296, 2004.

Yang, "Preparation and Analysis of Monoclonal Antibody Against EPHA4 Peptide", J.Cent. South Univ.(Med Sci), 30(5):529-532. English translation of original Chinese article; (2005).

Yokote et al., "Trans-activation of EphA4 and FGF receptors mediated by direct interactions between their cytoplasmic domains", PNAS, 102(52):18866-18871 (2005).

Zhao et al., "Role of p21-activated kinase pathway defects in the cognitive deficits of Alzheimer disease", Nat Neurosci. 9(2):234-42 (2006).

Zou et al., "Linking Receptor-mediated Endocytocis and Cell Signalling" Evidence for Regulated Intramembrane Proteolysis of Megalin in Proximal Tubule, J, Biol. Chem , vol. 279, No. 33, pp. 34302-34310 (2004).

Aoki et al., EphA Receptors Direct the Differentiation of Mammalian Neural Precursor Cells through a Mitogen-activated Protein Kinase-dependent Pathway, J. BioI. Chem., 2004, vol. 279, No. 31, P.32643-32650.

Esumi et al., "Expression of receptor type tyrosine kinase EphA4 in the spinal cord of autopsy and normal cases", Shinkei Hensei Shikkan ni Kansuru Kenkyuhan 2000 Nendo Kenkyu Hokokusho, 2001, pp. 48 to 50.

Extended Search Report for EP Application No. 11848175.3 dated Jul. 21, 2014.

Inoue et al., "Alzheimer's Disease (AD), No ni Okeru EphA4/ gamma-secretase Signal no Henka", Dement. Jpn., Nov. 15, 2011 (15. 10.2011), vol. 25, No. 3, p. 339.

International Search Report for PCT/JP2012/061097 dated Aug. 7, 2012.

Lin et al., "Ephrin-B2-induced Cleavage of EphB2 Receptor Is Mediated by Matrix Metalloproteinases to Trigger Cell Repulsion", J. Biol. Chem., 283(43):28969-28979 (2008).

\* cited by examiner

**p<0.01

SCREENING METHOD USING GELATINASE-MEDIATED EPHA4 CLEAVAGE REACTION AS AN INDICATOR

CROSS-REFERENCE TO RELATED APPLICATIONS

This is the U.S. National Phase, submitted pursuant to 35 U.S.C. §371, of International Patent Application No. PCT/JP2011/078460 filed on Dec. 8, 2011, which claims priority to application no. JP 2010-282165 filed in Japan on Dec. 17, 2010. The disclosures of these prior applications are hereby incorporated by reference and in their entireties.

REFERENCE TO SEQUENCE LISTING

A Sequence Listing is submitted herewith, pursuant to 37 C.F.R. 1.821(c), as an ASCII compliant text file named "SeqList2.txt" which was created on Jun. 27, 2013 and has a size of 1,028,504 bytes. The contents of the aforementioned "SeqList2.txt" file are hereby incorporated by reference and in their entirety.

TECHNICAL FIELD

The present invention relates to a screening method using gelatinase (MMP-2 or MMP-9)-mediated EphA4 cleavage reaction as an indicator.

BACKGROUND ART

Eph receptor A4 (EphA4) is a member of the receptor tyrosine kinase family and is a molecule regulating postsynaptic morphogenesis. It is known that knockout of EphA4 or expression of an EphA4 dominant-negative mutant causes a reduction in the number of spines, which are small thorn-like protrusions found on dendrites, and also makes their shape slender (Non-patent Document 1). It is generally proposed that the processes of memory and learning are reflected in the number and/or morphology of spines.

Recent studies have clarified that this EphA4 undergoes γ-secretase-mediated cleavage and the cleaved intracellular fragment activates a small GTP-binding protein, Rac, to thereby promote spine formation (Patent Documents 1 and 2, and Non-patent Document 2). Substrates of γ-secretase are first cleaved in their ectodomains by another protease and then cleaved by γ-secretase. It is known that cleavage of the EphA4 ectodomain is induced in a neuronal activity-dependent manner (Non-patent Document 2). On the other hand, in this series of cleavage processes, the first ectodomain cleavage reaction is known to be a rate-limiting step.

The MMP (matrix metalloproteinase) family, which includes enzymes cleaving off the ectodomain of EphA4, is divided into the classical MMP family and the ADAM family, and there are nearly 50 members in total. Many substrates of γ-secretase, such as Notch and APP, are known to be cleaved by ADAM protease (Non-patent Document 3). Among molecules classified as classical MMPs in the MMP family, MMP-2 and MMP-9 belonging to the gelatinase family are known to be highly expressed in the central nervous system, activated in a neuronal activity-dependent manner, and involved in spine formation (Non-patent Document 4).

However, there is no report at all of the relationship between the gelatinase family and EphA4, and it has never been clarified whether EphA4 is cleaved by gelatinase family molecules.

PRIOR ART DOCUMENTS

Patent Documents

Patent Document 1: WO2008/150010
Patent Document 2: WO2009/069808

Non-Patent Documents

Non-patent Document 1: Murai K K, Nguyen L N, Irie F, Yamaguchi Y, Pasquale E B. Control of hippocampal dendritic spine morphology through ephrin-A3/EphA4 signaling. Nat Neurosci. 2003 February; 6(2):153-60.
Non-patent Document 2: Inoue E, Deguchi-Tawarada M, Togawa A, Matsui C, Arita K, Katahira-Tayama S, Sato T, Yamauchi E, Oda Y, Takai Y. Synaptic activity prompts gamma-secretase-mediated cleavage of EphA4 and dendritic spine formation. J. Cell Biol. 2009 May 4; 185(3): 551-64.
Non-patent Document 3: Landman N, Kim T W. Got RIP? Presenilin-dependent intramembrane proteolysis in growth factor receptor signaling. Cytokine Growth Factor Rev. 2004 October; 15(5):337-51.
Non-patent Document 4: Ethel I M, Ethel D W. Matrix metalloproteinases in brain development and remodeling: synaptic functions and targets. J Neurosci Res. 2007 October; 85(13):2813-23.

SUMMARY OF THE INVENTION

Problem to be Solved by the Invention

The object of the present invention is to provide a screening method using gelatinase family molecule (MMP-2, MMP-9)-mediated EphA4 cleavage reaction as an indicator.

Means to Solve the Problem

As a result of extensive and intensive efforts made to achieve the above object, the inventors of the present invention have found that EphA4 ectodomain cleavage reaction, which is induced in hippocampal primary cultured neurons in a neuronal activity-dependent manner, is completely inhibited by a gelatinase (MMP-2, MMP-9)-selective inhibitor, mmp-2/9 Inhibitor II. Based on this finding, the inventors have further found that it is possible to screen a compound which enhances or reduces EphA4 processing mediated by γ-secretase or a compound which enhances or reduces spine formation mediated by the γ-secretase-processed EphA4 intracellular fragment. These findings led to the completion of the present invention.

Namely, the present invention provides a method for screening a substance that affects gelatinase-mediated EphA4 processing, which comprises the steps of:
(a) allowing a first biological composition containing gelatinase or a biologically active fragment thereof to be contacted with a second biological composition containing EphA4 in the presence and absence of a candidate substance;
(b) measuring the presence or amount of the EphA4 ectodomain and/or endodomain fragment; and
(c) selecting the candidate substance as a substance that affects gelatinase-mediated EphA4 processing if the results of the step (b) measured in the presence of the candidate substance are changed in comparison with the results of the step (b) measured in the absence of the candidate substance.

In the present invention, γ-secretase may further be present during the above step (a).

In the present invention, the above step (c) comprises identifying the candidate substance as a substance that promotes gelatinase-mediated EphA4 processing if the EphA4 endodomain and/or ectodomain fragment measured in the presence of the candidate substance during the above step (b) is increased in comparison with the EphA4 endodomain and/or ectodomain fragment measured in the absence of the candidate substance during the above step (b). In this case, the substance that stimulates gelatinase-mediated EphA4 processing can further be evaluated as a substance that promotes γ-secretase-mediated EphA4 cleavage reaction. Alternatively, the substance that promotes gelatinase-mediated EphA4 processing can further be evaluated as a substance that promotes spine formation reaction mediated by the EphA4 intracellular fragment.

On the other hand, the above step (c) comprises identifying the candidate substance as a substance that inhibits gelatinase-mediated EphA4 processing if the EphA4 endodomain and/or ectodomain fragment measured in the presence of the candidate substance during the above step (b) is decreased in comparison with the EphA4 endodomain and/or ectodomain fragment measured in the absence of the candidate substance during the above step (b). In this case, the substance that inhibits gelatinase-mediated EphA4 processing can further be evaluated as a substance that inhibits γ-secretase-mediated EphA4 cleavage reaction. Alternatively, the substance that inhibits gelatinase-mediated EphA4 processing can further be evaluated as a substance that inhibits spine formation reaction mediated by the EphA4 intracellular fragment.

The present invention further provides an ectodomain cleavage agent for EphA4, which comprises gelatinase or a biologically active fragment thereof.

The present invention further provides an assay kit for measurement of gelatinase-mediated EphA4 processing or an assay kit for measurement of spine formation, which comprises a first biological composition containing gelatinase or a biologically active fragment thereof and a second biological composition containing EphA4.

The assay kits of the present invention may further comprise a biological composition containing γ-secretase.

Effects of the Invention

The present invention provides a screening method using EphA4 cleavage reaction as an indicator. The present invention enables the screening of a substance that promotes or inhibits EphA4 cleavage reaction. The present invention enables the screening of a substance that enhances or reduces spine formation.

The present invention will be described in more detail below.

DESCRIPTION OF EMBODIMENTS

The present invention will be described in more detail below.

1. Overview

The present invention is directed to a method for screening a substance that affects gelatinase-mediated EphA4 processing. This method has now been completed based on the finding that gelatinase cleaves EphA4.

Figure 1:
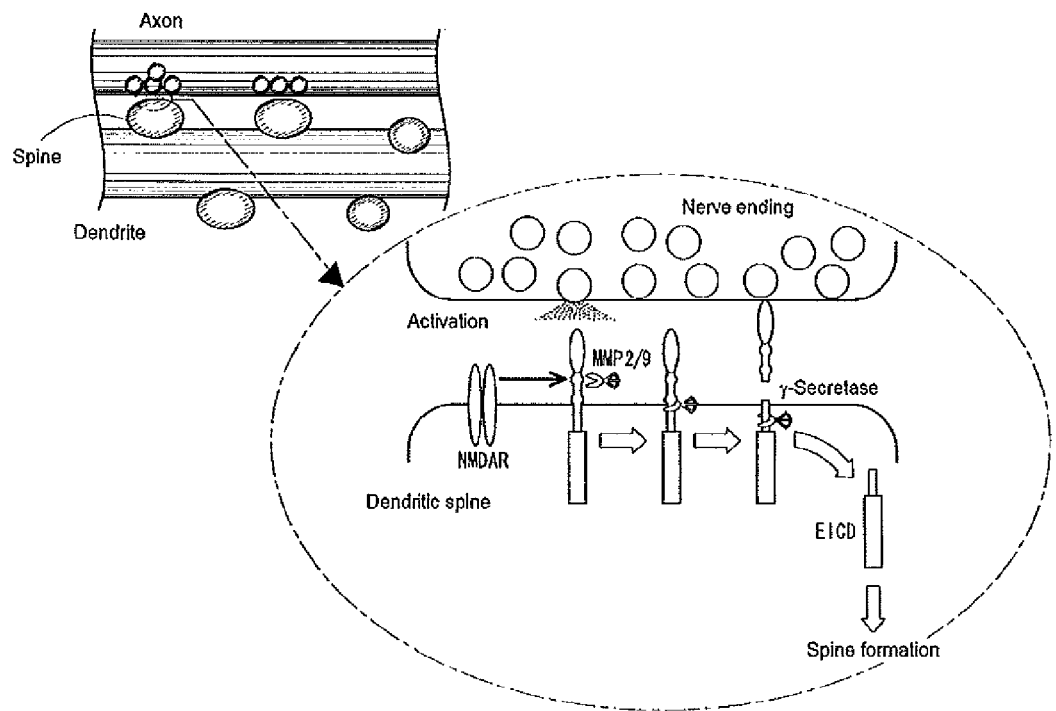
FIG. 1 schematically shows cleavage processing of EphA4 and spine formation.

FIG. 1 schematically shows cleavage processing of EphA4 and spine formation.

A shown in FIG. 1, once neuronal activity has occurred and neurotransmitters have acted on the NMDA receptor (NMDAR), which is a glutamate receptor, MMP (matrix metalloproteinase)-mediated EphA4 cleavage reaction will be induced and the cleaved endodomain fragment (i.e., a fragment including a transmembrane domain and an intracellular domain) will further be cleaved by γ-secretase to produce an EphA4 intracellular domain (EICD). This EICD has the ability to form and stabilize spines.

Although many types of MMPs are expressed in the brain, the present invention has clarified that among these MMPs, MMP-2 or MMP-9 (collectively referred to as gelatinase) cleaves EphA4.

In view of the foregoing, a substance that promotes the activity of gelatinase is a substance that promotes a series of the following processing steps:

(i) promotion of gelatinase-mediated EphA4 cleavage reaction, as a result of which EphA4 is cleaved into the ectodomain fragment and the endodomain fragment (i.e., a fragment including a transmembrane domain and an EICD), followed by (ii) γ-secretase-mediated cleavage of the EphA4 endodomain fragment, and (iii) production of the EICD.

Thus, a substance that suppresses the activity of gelatinase can be regarded as a substance that suppresses the above processing steps.

As described above, the action of gelatinase is to cleave EphA4 into the ectodomain and endodomain fragments. The gelatinase-cleaved ectodomain fragment of EphA4 is released into the extracellular environment. Thus, when EphA4 is treated with gelatinase together with a candidate substance and the released fragments are collected and analyzed by ELISA or the like, it is possible to quantify changes in cleavage efficiency and thereby to screen a substance that affects the action of gelatinase. Likewise, the gelatinase-cleaved endodomain fragment of EphA4 allows quantification of changes in cleavage efficiency and thereby screening of a substance that affects the action of gelatinase, when the cells are collected and analyzed for fragments contained therein (including the cell membrane fraction) by ELISA or the like. Moreover, the gelatinase-cleaved endodomain fragment of EphA4 further undergoes γ-secretase-mediated cleavage to produce an intracellular domain (EICD). Thus, when a fusion gene is prepared in advance to have a transcription factor linked to the C-terminal end of EphA4 (i.e., the end of the endodomain fragment) and is allowed to be expressed in neurons, the γ-secretase-cleaved EICD-transcription factor fusion molecule migrates into the nucleus and thereby allows enhanced expression of a reporter gene whose expression is designed to be controlled by the transcription factor. As a result, EICD production can be quantified.

Thus, when gelatinase is allowed to act on neurons or the like in the presence of a candidate substance, it is possible to examine whether the candidate substance will affect the activity of gelatinase by measuring the presence or amount of the EphA4 ectodomain fragment or the presence or amount of the EphA4 endodomain fragment, particularly the intracellular domain EICD.

The inventors of the present invention have demonstrated, ahead of others, that EphA4 ectodomain cleavage reaction, which is induced in hippocampal primary cultured neurons in a neuronal activity-dependent manner, is completely inhibited by a gelatinase (MMP-2, MMP-9)-selective inhibitor, mmp-2/9 Inhibitor II. Moreover, the inventors have also found, ahead of others, that gelatinase-mediated cleavage reaction can be quantified by ELISA assay using an antibody specific for the EphA4 ectodomain or by Western blot assay using an antibody specific for the EphA4 endodomain fragment.

Namely, the inventors of the present invention have shown that EphA4 ectodomain cleavage reaction, which determines the efficiency of γ-secretase-mediated cleavage reaction in EphA4, is suppressed by gelatinase inhibitors. In light of this finding, the inventors have shown that a screening method based on gelatinase-mediated cleavage reaction of EphA4 is effective.

Enhancers and inhibitors of gelatinase-mediated cleavage reaction of EphA4 obtained by the screening method of the present invention are respectively involved in activation and deactivation of gelatinase, and these enhancers and inhibitors are substances (e.g., compounds) that act on EphA4 to respectively activate or deactivate the gelatinase-catalyzed enzymatic reaction.

Further, in light of the fact that EphA4 ectodomain cleavage reaction is a factor determining the efficiency of γ-secretase-mediated cleavage reaction, enhancers and inhibitors of gelatinase-mediated cleavage reaction of EphA4 can be regarded not only as substances (e.g., compounds) that respectively enhance or reduce γ-secretase-mediated EphA4 processing, but also as substances (e.g., compounds) that respectively enhance or reduce spine formation via the γ-secretase-processed EphA4 intracellular fragment.

2. Screening Methods

As described in the section "1. Overview" above, when gelatinase is allowed to act on EphA4 in neurons or the like in the presence of a candidate substance, it is possible to examine whether the candidate substance will affect the activity of gelatinase by measuring the presence or amount of the EphA4 ectodomain fragment or the presence or amount of the EphA4 endodomain fragment (particularly EICD).

Thus, the present invention is directed to a method for screening a substance that affects gelatinase-mediated EphA4 processing, which comprises the steps of:
(a) allowing a first biological composition containing gelatinase or a biologically active fragment thereof to be contacted with a second biological composition containing EphA4 in the presence and absence of a candidate substance;
(b) measuring the presence or amount of the EphA4 eetodomain and/or endodomain fragment; and
(c) selecting the candidate substance as a substance that affects gelatinase-mediated EphA4 processing if the results of the step (b) measured in the presence of the candidate substance are changed in comparison with the results of the step (b) measured in the absence of the candidate substance.

As used herein, the term "contact" is intended to mean that the first biological composition and the second biological composition are placed in an environment where they can be reacted with each other under given conditions, as exemplified by mixing of the second biological composition into the first biological composition, mixing of the first biological composition into the second biological composition, culturing of a mixture of these compositions, co-culturing of a transformant carrying a gelatinase-encoding gene with a transformant carrying an EphA4-encoding gene, co-expression of a gelatinase-encoding gene with an EphA4-encoding gene, etc.

The first biological composition contains gelatinase or a biologically active fragment thereof, while the second biological composition contains EphA4. Upon contacting these two compositions with each other, EphA4 cleavage reaction will proceed by the action of gelatinase. In a case where this reaction system is a cell-free or cell-based system containing γ-secretase, when the reaction between the first biological composition and the second biological composition is allowed to proceed in the presence of a candidate substance, cleavage fragments of EphA4 are produced by the action of gelatinase and then γ-secretase-mediated cleavage reaction occurs in the EphA4 endodomain fragment to produce EICD if the candidate substance is a substance that promotes the action of gelatinase. Since gelatinase-catalyzed enzymatic reaction will proceed even in the absence of a candidate substance, when a reaction system free from the candidate substance is used as a control, the candidate substance can be evaluated as a substance that promotes the action of gelatinase if the amount of the ectodomain fragment, the endodomain fragment or both thereof is increased in comparison with the control, or alternatively, the candidate substance can be evaluated as a substance that inhibits the action of gelatinase if the amount of the ectodomain fragment, the endodomain fragment or both thereof is decreased in comparison with the control. As a result, the cleaved ectodomain fragment and/or the produced endodomain fragment (particularly EICD) can be used as an indicator to evaluate whether or not the candidate substance promotes the action of gelatinase.

Thus, in one embodiment of the method of the present invention, the candidate substance is identified as a substance that promotes gelatinase-mediated EphA4 processing if the EphA4 endodomain and/or ectodomain fragment measured in the presence of the candidate substance during the above step (b) is increased in comparison with that measured in the absence of the candidate substance, whereas the candidate substance is identified as a substance that inhibits gelatinase-mediated EphA4 processing if the EphA4 endodomain and/or ectodomain fragment measured in the presence of the candidate substance during the above step (b) is decreased in comparison with that measured in the absence of the candidate substance. Moreover, the substance that promotes gelatinase-mediated EphA4 processing can further be evaluated as a substance that enhances γ-secretase-mediated EphA4 cleavage reaction, whereas the substance that inhibits gelatinase-mediated EphA4 processing can be evaluated as a substance that inhibits γ-secretase-mediated EphA4 cleavage reaction.

Likewise, the substance that promotes gelatinase-mediated EphA4 processing can further be evaluated as a substance that enhances spine formation reaction mediated by the EphA4 intracellular fragment, whereas the substance that inhibits gelatinase-mediated EphA4 processing can be evaluated as a substance that inhibits spine formation reaction mediated by the EphA4 intracellular fragment.

The presence or amount of the cleaved ectodomain fragment and/or the endodomain fragment (particularly EICD) may be measured, e.g., by ELISA or Western blotting using antibodies against these fragments or the like (details will be described later).

As used herein, the term "gelatinase" refers to a molecule classified as a classical MMP in the MMP family and includes MMP-2 and MMP-9. In the present invention, gelatinase may be a polypeptide of any animal origin, a recombinant polypeptide or a synthetic polypeptide. Moreover, although gelatinase is preferably in its full-length form, a biologically active fragment (partial sequence) thereof or a mutated sequence of the full-length sequence or a partial fragment thereof may also be possible as long as it has matrix metalloproteinase activity. A mutant or biologically active fragment (e.g., partial sequence) of gelatinase may be a polypeptide substantially functionally equivalent to gelatinase, which comprises an amino acid sequence with deletion, substitution, insertion and/or addition of one or more (preferably one or several) amino acids in the full-length or partial sequence of gelatinase or with any combination of these modifications.

As described above, gelatinase or a biologically active fragment thereof has the ability to cleave off the ectodomain of EphA4 and hence is used as an ectodomain cleavage agent for EphA4.

As used herein, the term "EphA4" refers to a known polypeptide serving as a regulatory factor for synapse formation and/or maintenance (Murai K K et al., Nat Neurosci. 2003 February; 6(2):153-60). For example, EphA4 intended in the present invention includes human EphA4 (NM_004438.3, BC026327, NP_004429.1, BAG35298.1), rhesus monkey (*Macaca mulatta*) EphA4 (XM_001106493.1, XM_001106620, XM_001106561, XM_001106876, XM_001106943, XM_001106806, XP_001106430.1), chimpanzee (*Pan troglodytes*) EphA4 (XM_001164636.1, XM_001164828, XM_526042, XM_001164899, XM_001164862, XM_001164676), rat EphA4 (XM_244186), mouse EphA4 (NM_007936.3, BC052164, X65138, BC004782, AK132203, AAH04782.1, NP_031962.2), gray short-tailed opossum (*Monodelphis domestica*) EphA4 (XM_001365826), domestic dog (*Canis familiaris*) EphA4 (XM_536084), avian (*Gallus gallus*) EphA4 (NM_204781, CAA79509.1), *Xenopus laevis* EphA4 (NM_001085992, L26099, NM_001096714, NP_001079461.1), zebrafish (*Danio rerio*) EphA4 (NM_001005919, XM_001342436), horse (*Equus caballus*) EphA4 (XP_001494588.1), pig (*Sus scrofa*) EphA4 (NP_001128439.1), platypus (*Ornithorhynchus anatinus*) EphA4 (XP_001506050.1) and so on. Preferred is mammalian EphA4. EphA4 structurally comprises a γ-secretase cleavage site, a transmembrane domain and a kinase active site, and its ligand is among the Ephrin A family (Aoto, J et al., Brain Res. 2006 11).

In the present invention, EphA4 may be any of the above animal-derived polypeptide, recombinant polypeptide and synthetic polypeptide. In the present invention, EphA4 is preferably in its full-length form, but a partial sequence thereof or a mutated sequence thereof may also be possible as long as it comprises at least the gelatinase-mediated cleavage site and γ-secretase-mediated cleavage site of EphA4. A mutant of EphA4 may be a polypeptide substantially functionally equivalent to EphA4, which comprises an amino acid sequence with deletion, substitution, insertion and/or addition of one or more (preferably one or several) amino acids in the full-length or partial sequence of EphA4 or with any combination of these modifications. Such a "polypeptide substantially functionally equivalent to EphA4" is intended to mean a polypeptide having the activity of EphA4, such as gelatinase- or γ-secretase-dependent cleavage activity.

As used herein, the term "γ-secretase" refers to a protease formed from presenilin (presenilin 1 or 2) and three types of cofactor proteins (nicastrin, Aph-1 and Pen-2). In the present invention, each protein constituting γ-secretase may be a polypeptide of any animal origin, a recombinant polypeptide or a synthetic polypeptide. Moreover, although each protein constituting γ-secretase is preferably in its full-length form, a partial sequence thereof or a mutated sequence thereof may also be possible as long as γ-secretase has proteolytic activity. A mutant of each protein constituting γ-secretase may be a polypeptide substantially functionally equivalent to γ-secretase formed therefrom, which comprises an amino acid sequence with deletion, substitution, insertion and/or addition of one or more (preferably one or several) amino acids in the full-length or partial sequence of each constituent protein or with any combination of these modifications. Such a "polypeptide substantially functionally equivalent to γ-secretase" is intended to mean a polypeptide having the activity of γ-secretase, such as proteolytic activity to cleave proteins (e.g., EphA4 whose ectodomain is cleaved off).

Table 1 shows the correspondence between nucleotide sequence and amino acid sequence for EphA4 derived from various animals, while Table 2 shows the correspondence between nucleotide sequence and amino acid sequence for human gelatinase. Likewise, Table 3 shows the correspondence between nucleotide sequence and amino acid sequence for γ-secretase derived from various animals.

TABLE 1

| Origin or Type | Accession No. | Nucleotide sequence | Amino acid sequence |
| --- | --- | --- | --- |
| Rat (*Rattus norvegicus*) | XM_244186.3 | SEQ ID NO: 1 | SEQ ID NO: 2 |
| Rat EphA4-HA | XM_244186 | SEQ ID NO: 3 | SEQ ID NO: 4 |
| Human (*Homo sapiens*) | NM_004438 | SEQ ID NO: 5 | SEQ ID NO: 6 |
| | BC026327 | SEQ ID NO: 7 | SEQ ID NO: 8 |
| | NP_004429.1 | SEQ ID NO: 9 | SEQ ID NO: 10 |
| | BAG35298.1 | SEQ ID NO: 11 | SEQ ID NO: 12 |
| Mouse (*Mus musculus*) | NM_007936 | SEQ ID NO: 13 | SEQ ID NO: 14 |
| | BC052164 | SEQ ID NO: 15 | SEQ ID NO: 16 |
| | X65138 | SEQ ID NO: 17 | SEQ ID NO: 18 |
| | BC004782 | SEQ ID NO: 19 | SEQ ID NO: 20 |
| | AK132203 | SEQ ID NO: 21 | SEQ ID NO: 22 |
| | AAH04782.1 | SEQ ID NO: 23 | SEQ ID NO: 24 |
| | NP_031962.2 | SEQ ID NO: 25 | SEQ ID NO: 26 |
| Gray short-tailed opossum (*Monodelphis domestica*) | XM_001365826 | SEQ ID NO: 27 | SEQ ID NO: 28 |
| Domestic dog (*Canis familiaris*) | XM_536084.2 | SEQ ID NO: 29 | SEQ ID NO: 30 |
| Chimpanzee (*Pan troglodytes*) | XM_001164636 | SEQ ID NO: 31 | SEQ ID NO: 32 |
| | XM_001164828 | SEQ ID NO: 33 | SEQ ID NO: 34 |
| | XM_526042.2 | SEQ ID NO: 35 | SEQ ID NO: 36 |
| | XM_001164899 | SEQ ID NO: 37 | SEQ ID NO: 38 |
| | XM_001164862 | SEQ ID NO: 39 | SEQ ID NO: 40 |
| | XM_001164676 | SEQ ID NO: 41 | SEQ ID NO: 42 |

TABLE 1-continued

| Origin or Type | Accession No. | Nucleotide sequence | Amino acid sequence |
|---|---|---|---|
| Rhesus monkey (*Macaca mulatta*) | XM_001106493 | SEQ ID NO: 43 | SEQ ID NO: 44 |
| | XM_001106620 | SEQ ID NO: 45 | SEQ ID NO: 46 |
| | XM_001106561 | SEQ ID NO: 47 | SEQ ID NO: 48 |
| | XM_001106876.1 | SEQ ID NO: 49 | SEQ ID NO: 50 |
| | XM_001106943 | SEQ ID NO: 51 | SEQ ID NO: 52 |
| | XM_001106806 | SEQ ID NO: 53 | SEQ ID NO: 54 |
| | XP_001106430.1 | SEQ ID NO: 55 | SEQ ID NO: 56 |
| Avian (*Gallus gallus*) | NM_204781 | SEQ ID NO: 57 | SEQ ID NO: 58 |
| | CAA79509.1 | SEQ ID NO: 59 | SEQ ID NO: 60 |
| *Xenopus laevis* | NM_001085992 | SEQ ID NO: 61 | SEQ ID NO: 62 |
| | L26099 | SEQ ID NO: 63 | SEQ ID NO: 64 |
| | NM_001096714 | SEQ ID NO: 65 | SEQ ID NO: 66 |
| | NP_001079461.1 | SEQ ID NO: 67 | SEQ ID NO: 68 |
| Zebrafish (*Danio rerio*) | NM_001005919 | SEQ ID NO: 69 | SEQ ID NO: 70 |
| | XM_001342436 | SEQ ID NO: 71 | SEQ ID NO: 72 |
| Horse (*Equus caballus*) | XP_001494588.1 | SEQ ID NO: 73 | SEQ ID NO: 74 |
| Pig (*Sus scrofa*) | NP_001128439.1 | SEQ ID NO: 75 | SEQ ID NO: 76 |
| Platypus (*Ornithorhynchus anatinus*) | XP_001506050.1 | SEQ ID NO: 77 | SEQ ID NO: 78 |

TABLE 2

| Origin or Type | Accession No. | Nucleotide sequence | Amino acid sequence |
|---|---|---|---|
| Human MMP-2 (*Homo sapiens*) | NM_001127891 | SEQ ID NO: 79 | SEQ ID NO: 80 |
| Human MMP-9 (*Homo sapiens*) | NM_004994 | SEQ ID NO: 81 | SEQ ID NO: 82 |

TABLE 3

| Origin or Type | Accession No. | Nucleotide sequence | Amino acid sequence |
|---|---|---|---|
| Mouse Presenilin 1 (*Mus musculus*) | NM_008943 | SEQ ID NO: 83 | SEQ ID NO: 84 |
| Rat Presenilin 1 (*Rattus norvegicus*) | D82363 | SEQ ID NO: 85 | SEQ ID NO: 86 |
| Human Presenilin 1 (*Homo sapiens*) | NM_000021 | SEQ ID NO: 87 | SEQ ID NO: 88 |
| Mouse Presenilin 2 (*Mus musculus*) | NM_011183 | SEQ ID NO: 89 | SEQ ID NO: 90 |
| Rat Presenilin 2 (*Rattus norvegicus*) | NM_031087 | SEQ ID NO: 91 | SEQ ID NO: 92 |
| Human Presenilin 2 (*Homo sapiens*) | NM_000447 | SEQ ID NO: 93 | SEQ ID NO: 94 |
| Mouse Nicastrin (*Mus musculus*) | NM_021607 | SEQ ID NO: 95 | SEQ ID NO: 96 |
| Rat Nicastrin (*Rattus norvegicus*) | NM_174864 | SEQ ID NO: 97 | SEQ ID NO: 98 |
| Human Nicastrin (*Homo sapiens*) | NM_015331 | SEQ ID NO: 99 | SEQ ID NO: 100 |
| Mouse Aph-1 (*Mus musculus*) | NM_146104 | SEQ ID NO: 101 | SEQ ID NO: 102 |
| Rat Aph-1 (*Rattus norvegicus*) | NM_001014255 | SEQ ID NO: 103 | SEQ ID NO: 104 |
| Human Aph-1 (*Homo sapiens*) | NM_016022 | SEQ ID NO: 105 | SEQ ID NO: 106 |
| Mouse Pen-2 (*Mus musculus*) | NM_025498 | SEQ ID NO: 107 | SEQ ID NO: 108 |
| Rat Pen-2 (*Rattus norvegicus*) | NM_001008764 | SEQ ID NO: 109 | SEQ ID NO: 110 |
| Human Pen-2 (*Homo sapiens*) | NM_172341 | SEQ ID NO: 111 | SEQ ID NO: 112 |

As used herein, the term "candidate substance" refers to a substance to be tested whether or not it has the ability to change the activity of gelatinase, preferably the activity of mammalian gelatinase, and such a substance may be of any type or origin. Examples include one or more substances selected from the group consisting of expression products of gene libraries, natural or synthetic small compounds (including compounds contained in libraries), nucleic acids (oligo DNAs, oligo RNAs), natural or synthetic peptides (including peptides contained in libraries), antibodies, substances released from bacteria (including substances released upon bacterial metabolism), extracts of cells (microorganisms, plant cells, animal cells), culture supernatants of cells (microorganisms, plant cells, animal cells), purified or partially purified peptides, extracts derived from various organisms (marine organisms, plants or animals), soil, and peptides contained in random phage peptide display libraries.

The above candidate substances may be either novel substances or known substances. Moreover, the above candidate substances may be modified by conventionally used chemical means, physical means and/or biochemical means. For example, they may be compounds modified to give structural analogs by being subjected to direct chemical modifications (e.g., acylation, alkylation, esterification, amidation) or random chemical modifications. The above candidate substances may also be compounds which are identified by pharmacophore search of compounds, computer-aided structure comparison programs, etc. These compounds may form salts, and the candidate compounds or salts thereof may further form solvates (including hydrates).

Further, the candidate substances may also be known gelatinase enhancers or gelatinase inhibitors involved in gelatinase processing, or structural analogs thereof. The above candidate substances may be compounds that can be designed on the basis of known compounds that promote or inhibit the activity of gelatinase through rational drug design. Examples of these compounds include NMDA, mmp-2/9 Inhibitor II and so on.

The structure of mmp-2/9 Inhibitor II (Merck) is shown below.

[Formula 1]

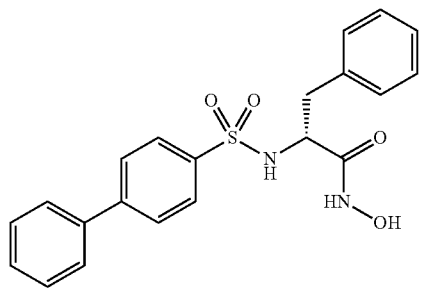

(2R)-[(4-Biphenylylsulfonyl)amino]-N-hydroxy-3-phenylpropionamide (BiPS)

In general, such a candidate substance may be incorporated into (e.g., added to) the reaction system at a co ncentration ranging from about 1 nM to 1 mM, usually about 10 μM to 1 mM. To identify a substance that changes the EphA4 cleavage activity of gelatinase, each step described above is performed in the presence and absence of a candidate substance, and the EphA4 cleavage activity of gelatinase in the presence of the candidate substance is compared with the activity in the absence of the candidate substance, whereby a substance that changes the activity of gelatinase-mediated EphA4 cleavage is identified.

Some change in the amount or degree (presence) of EphA4 in the presence of a candidate substance is indicative of a change in the activity of gelatinase-mediated EphA4 cleavage in the presence of the candidate substance, which means that a substance serving as a modulator for gelatinase activity has been identified. For example, a substance that enhances the production of EphA4 cleavage products in comparison with its control is evaluated as an enhancer for the proteolytic activity of gelatinase. On the other hand, a substance that reduces the production of EphA4 cleavage products in comparison with its control is evaluated as an inhibitor for the proteolytic activity of gelatinase.

Gelatinase enhancers or modulators obtained by the method of the present invention have the potential to be useful for treatment of Alzheimer's disease (AD). Likewise, gelatinase inhibitors obtained by the method of the present invention have the potential to be useful for treatment of diseases associated with excessive formation of synapses, particularly spines.

As used herein, the term "ectodomain fragment" refers to an N-terminal fragment of EphA4, which will be released into the extracellular environment upon gelatinase-mediated cleavage (see FIG. 1).

As used herein, the term "endodomain fragment" refers to a cleavage product of EphA4 after gelatinase-mediated cleavage, i.e., a C-terminal fragment of EphA4 except for the ectodomain fragment. The endodomain fragment includes a transmembrane domain and an intracellular domain, and it serves as a substrate of γ-secretase. A subfragment produced from the endodomain fragment upon γ-secretase-mediated cleavage is referred to as an EphA4 intracellular domain (EICD), Thus, EICD is a concept falling within the "endodomain fragment."

As used herein, the term "substitution" is preferably intended to mean conservative substitution, in which one or more (preferably one or several) amino acid residues are replaced with other chemically similar amino acid residues such that the activity of the resulting polypeptide is not substantially altered. Examples include cases where one hydrophobic residue is replaced with another hydrophobic residue and where one polar residue is replaced with another polar residue having the same charge. For each amino acid, its functionally similar amino acids allowing such substitution are known in the art. More specifically, examples of non-polar (hydrophobic) amino acids include alanine, valine, isoleucine, leucine, proline, tryptophan, phenylalanine, methionine and so on. Examples of polar (neutral) amino acids include glycine, serine, threonine, tyrosine, glutamine, asparagine, cysteine and so on. Examples of positively-charged (basic) amino acids include arginine, histidine, lysine and so on. Likewise, examples of negatively-charged (acidic) amino acids include aspartic acid, glutamic acid and so on.

The number of amino acids which may be deleted, substituted, inserted and/or added as described above is, e.g., 1 to 30, preferably 1 to 20, more preferably 1 to 10, even more preferably 1 to 5, and particularly preferably 1 or 2.

Mutated amino acid sequences of the individual proteins constituting the above gelatinase, EphA4 and γ-secretase include amino acid sequences sharing a homology of preferably 80% or more, more preferably 85% or more, even more preferably 90% or more, still even more preferably 95% or more, particularly preferably 98% or more, and most preferably 99% or more with the amino acid sequences of their respective wild-type polypeptides. Polypeptides comprising amino acid sequences each having the above homology fall within mutated polypeptides to be used in the present invention, as long as they have substantially the same activity as EphA4 (e.g., the ability to cause a morphological change in postsynapses, particularly to cause an Ephrin A-dependent morphological change), substantially the same activity as gelatinase (e.g., the ability to cause cleavage of EphA4) or substantially the same activity as γ-secretase (e.g., the ability to cause cleavage of the EphA4 endodomain fragment). These polypeptides may be any of the above animal-derived polypeptides, recombinant polypeptides and synthetic polypeptides.

The above identity may be a numerical value calculated using any homology search program known to those skilled in the art, for example, may be calculated using default (initial setting) parameters in the homology algorithm BLAST (Basic Local Alignment Search Tool) program of the National Center for Biotechnology Information (NCBI), available at http://www.ncbi.nlm.nih.gov/BLAST/.

In the present invention, gelatinase to be used, EphA4 to be analyzed, and γ-secretase to be optionally used may be in the form of fusion polypeptides fused with other polypeptides, as exemplified by tagged or labeled polypeptides or otherwise modified polypeptides. These polypeptides may be obtained by gene recombination techniques, site-directed mutagenesis, treatment with mutagens (e.g., hydroxylamine), or automated peptide synthesis.

EphA4 derivatives each carrying at least gelatinase- and γ-secretase-mediated cleavage sites can all be used in the present invention. These polypeptides are particularly useful in detection and/or purification of EphA4.

As used herein, the term "biological composition" refers to any composition containing gelatinase or EphA4, as exemplified by a cell-free reconstituted system, an expression product obtained by genetic engineering procedures, a mammal or a part thereof, or a transgenic non-human mammal or a part thereof engineered to overexpress gelatinase or EphA4. The biological composition intended in the present invention may also be a composition containing γ-secretase.

In the context of the present invention, gelatinase and/or EphA4 may be either endogenous or exogenous. In the case of endogenous gelatinase and/or EphA4, any composition is possible as long as it contains gelatinase or EphA4 derived from a part of the above animal. A part of the above animal used for this purpose may be, for example, a tissue, cell, cell membrane fraction or purified membrane derived from the above animal. Examples of such a cell include cells in the central nervous system, neuronal cells (e.g., brain-derived neurons, cerebral cortex-derived neurons, cerebral cortex-derived primary cultured neurons, hippocampus-derived primary cultured neurons), glia cells and so on.

Moreover, in these cells, gelatinase and/or EphA4 may be in the state of being contained in a mammal or a part thereof or may be the gelatinase or EphA4 fraction of a cell lysate prepared from the mammal. Such a cell lysate may be prepared from gelatinase- or EphA4-containing cells, e.g., by lysis with a hypotonic solution or a surfactant or by ultrasonic or physical homogenization, optionally followed by treatment with a purification means such as a column. In the case of exogenous gelatinase and/or EphA4, the intended composition may be gelatinase-expressing cells or EphA4-expressing cells obtained when the whole or a part of an expression vector carrying a gelatinase-encoding polynucleotide or an EphA4-encoding polynucleotide is used and expressed in host cells, or alternatively, may be the gelatinase fraction of a cell lysate derived from gelatinase-expressing cells or the gelatinase fraction of a cell lysate derived from EphA4-expressing cells. Such a cell lysate may be prepared from gelatinase- or EphA4-containing cells, e.g., by lysis with a hypotonic solution or a surfactant or by ultrasonic or physical homogenization, optionally followed by treatment with a purification means such as a column. The expression vectors used for this purpose may be those which are to be transformed or transfected into host cells to cause transient gene expression, or may be those which are to be integrated into the genome of host cells to ensure stable gene expression.

As used herein, the term "transformation" or "transfection" is intended to mean any technique which changes the DNA content of eukaryotic cells. Examples include calcium phosphate transfection, protoplast fusion transfection, electroporation transfection, DEAE-dextran transfection, liposome transfection, polybrene transfection, direct microinjection transfection and so on (Sambrook, et al., Molecular Cloning 3:16.30-16.31 (1989)).

Expression vectors used for the above transformation or transfection are not limited in any way as long as they carry a gelatinase-encoding polynucleotide or an EphA4-encoding polynucleotide, and examples include plasmids which are obtained by inserting these polynucleotides into known expression vectors selected as appropriate depending on the type of host cell to be used. For example, promoters may be used in mammalian cells for the purpose of giving strong transcriptional activity, as exemplified by CMV immediate early promoter, retrovirus promoters (e.g., LTR from MLU or MMTV), SV40, RSV LTR, HIV-1 LTR and HIV-2 LTR promoters, adenovirus promoters (e.g., those from the E1A, E2A and MLP regions), as well as AAV LTR, cauliflower mosaic virus, HSV-TK and avian sarcoma virus promoters.

The thus transformed or transfected host cells are also not limited in any way as long as they contain a gelatinase-encoding polynucleotide or an EphA4-encoding polynucleotide. For example, they may be transformants which have the polynucleotides integrated into the chromosomes of the host cells, may be transformants which contain plasmids carrying the polynucleotides, or may be transformants which are not expressing gelatinase or EphA4. These transformants may be obtained upon transformation of desired host cells with the above plasmids or with the above polynucleotides per se.

Host cells to be transformed or transfected with the above expression vectors may be cells or cell lines capable of gene expression, as exemplified by known cultured cells. Examples include mammalian cells or cell lines, such as HEK293 cells, Chinese hamster ovary (CHO) cells, fibroblasts, primary endothelial cells (HUVEC cells), human glioma cells, Hela cells, COS cells, PC12 cells, lymphoblasts, melanoma cells, hybridoma cells, oocytes and embryonic stem cells; known microorganisms such as *E. coli* and yeast; as well as insect cells (e.g., BmN4 cells) and so on. Any of the above cells may be used as long as it is expressing at least one of gelatinase and EphA4, which may be either endogenous or exogenous.

Examples of the above expression vectors include pUC, pTV, pGEX, pKK or pTrcHis for *E. coli*, pEMBLY or pYES2 for yeast, pcDNA3, pMAMneo or pBabe Pura for animal cells (CHO cells, HEK293 cells and COS cells), as well as vectors (e.g., pBK283) carrying the polyhedrin promoter of *Bombyx mori* nuclear polyhedrosis virus (BmNPV) for insect cells (BmN4 cells).

Although the above gelatinase- and/or EphA4-containing cells are not limited in any way, for example, gelatinase- and EphA4-expressing cells in which one of gelatinase and EphA4 is endogenous and the other is exogenous, or cells which express both exogenous gelatinase and exogenous EphA4 may also be obtained by being cultured under conditions allowing expression of gelatinase and/or EphA4.

Alternatively, appropriate cells may be injected with gelatinase-encoding RNA and/or EphA4-encoding RNA and cultured under conditions allowing expression of gelatinase and/or EphA4 to thereby obtain desired cells.

The above cell membrane fraction may be obtained, e.g., by homogenizing the gelatinase- or EphA4-expressing cells of the present invention and then separating a fraction rich in cell membranes. Techniques for cell homogenization include, for example, cell crushing with a homogenizer, homogenization with a Waring blender or a Polytron, ultrasonic homogenization, or ejection of cells through a narrow nozzle under pressure with a French press or the like. Likewise, techniques for cell membrane fractionation include, for example, centrifugal fractionation, such as differential centrifugation or density gradient centrifugation.

To purify the cell membrane fraction, known protein purification techniques can be used. These techniques comprise, as one of their steps, rough fractionation of cells into the polypeptide fraction and the non-polypeptide fraction. Once gelatinase or EphA4 has been separated from the other polypeptides, the desired gelatinase or EphA4 will be further purified by using chromatographic or electrophoretic techniques to ensure partial purification or complete purification (or to ensure a uniform state through purification).

Analysis techniques particularly suitable for preparation and purification of pure peptides include, for example, precipitation with ammonium sulfate, PEG, antibody and so on, or centrifugation following thermal denaturation. Moreover, it is also possible to use various chromatographic steps such as ion exchange chromatography, gel filtration chromatography, reversed-phase chromatography, hydroxylapatite chromatography, affinity chromatography, fast protein liquid chromatography (FPLC), high performance liquid chromatography (HPLC) or immobilized metal affinity chromatography (IMAC), as well as isoelectric focusing, gel electrophoresis, SDS (sodium dodecyl sulfate)-polyacrylamide gel electrophoresis (SDS-PAGE) and so on, which may be used either alone or in combination, as appropriate. In addition to these techniques, other techniques may also be used in combination.

Alternatively, purification may be accomplished as follows: gelatinase or EphA4 is tagged in advance and passed through a purification column, to which a protein recognizing this tag has been attached, whereby the desired gelatinase or EphA4 is adsorbed within the column, followed by passing an appropriate elution solvent through the column to desorb the gelatinase or EphA4. Various purification steps may be performed in different orders, or some of the steps may be skipped. One of the techniques preferred for evaluation of the fraction purity is as follows: the specific activity of a fraction is calculated and then compared with the specific activity of the original extract, whereby the level of purity is calculated for evaluation.

In the present invention, it is also possible to use γ-secretase or a biological composition containing γ-secretase, which is prepared in the same manner as described above for gelatinase or EphA4.

As used herein, the term "EphA4 processing" is intended to mean a process during which the EphA4 protein undergoes modifications, Processing (modification) includes addition, modification, cleavage and removal of amino acids or peptide chains, as well as folding of proteins, etc. In the context of the present invention, EphA4 processing is preferably intended to mean a process during which EphA4 is cleaved or a reaction by which EphA4 is cleaved.

As used herein, the phrase "substance that affects gelatinase-mediated EphA4 processing" is intended to mean either a substance that inhibits the activity of gelatinase-mediated EphA4 cleavage (i.e., a gelatinase inhibitor) or a substance that promotes the activity of gelatinase-mediated EphA4 cleavage (i.e., a gelatinase enhancer). In the context of the present invention, the gelatinase inhibitor includes an antagonist, and the gelatinase enhancer includes an agonist. The gelatinase inhibitor and gelatinase enhancer also include substances that change the site for gelatinase-mediated EphA4 cleavage to produce EphA4 cleavage products having different peptide lengths.

The method of the present invention can be performed in an appropriate cell-based or cell-free system containing gelatinase and EphA4. In a cell-based system containing gelatinase and EphA4, cells to be used may be either endogenous gene-expressing cells or exogenous gene-containing cells. In the presence and absence of a candidate substance, cells containing gelatinase and EphA4 may be cultured in an appropriate medium and incubated under reaction conditions which allow EphA4 cleavage reaction through gelatinase activity. In the present invention, glutamate receptors present in the reaction system may be activated by neurotransmitters such as NMDA during contact.

In the case of an exogenous gene-containing cell-based system, the method of the present invention can be performed under culture conditions which allow expression of the gene. In an endogenous gene-expressing cell-based system, primary cultured neurons may be cultured, for example, under culture conditions of 5% $CO_2$ and 37° C. in MEM (Invitrogen) medium supplemented with 5% FBS (Hyclone), 1×B27 supplement (Invitrogen), 0.5 mM L-glutamine (Invitrogen), 25 μg/ml insulin (SIGMA) and 8 μM AraC (SIGMA). In an exogenous gene-containing system, HEK293 cell line may be cultured, for example, under culture conditions of 5% $CO_2$ and 37° C. in 10% FBS (Hyclone)/DMEM (Invitrogen). In a cell-free system, a first biological composition containing gelatinase or a biologically active fragment thereof (e.g., a cell membrane fraction containing gelatinase) and a second biological composition containing EphA4 (e.g., a cell membrane fraction containing EphA4) are incubated by being mixed together in the presence and absence of a candidate compound. These compositions may be mixed under reaction conditions which allow EphA4 cleavage reaction through gelatinase activity. Gelatinase or EphA4 may be the purified gelatinase or EphA4, or a biologically active fragment thereof, an analog thereof, or a mutant thereof.

For analysis of EphA4 cleavage, a parameter indicative of cleavage is measured for either or both of the N-terminal and C-terminal fragments of EphA4. To monitor gelatinase-mediated EphA4 cleavage or the subsequent γ-secretase-mediated endodomain cleavage, it is possible to use an anti-EphA4 antibody, such as an antibody capable of recognizing a fragment generated as a result of EphA4 cleavage, preferably an antibody capable of recognizing a fragment of the EphA4 ectodomain or an antibody capable of recognizing a fragment of the EphA4 endodomain, more preferably an antibody capable of recognizing a C-terminal region fragment (particularly EICD) of EphA4. For detection of tagged polypeptide cleavage products of EphA4, it is possible to use an antibody capable of recognizing the selected tag. For example, when an HA tag is attached to the C-terminal end of EphA4, an anti-HA tag antibody may be used for detection. In this case, it is possible to clarify the presence and concentration of the C-terminal end of EphA4 which is generated as a result of EphA4 cleavage.

Systems particularly useful as tagged polypeptides include the hemagglutinin (HA) system, the glutathione-S-transferase (GST) system, the maltose-binding protein system, the 6× histidine system, the 8× histidine system and so on.

When EphA4 or tagged EphA4 is labeled, the quenched state of the label may be detected.

Alternatively, in the present invention, it is also possible to use an assay system designed such that a fusion gene is prepared to have a transcription factor linked to the C-terminal end of EphA4 and this fusion gene is allowed to be expressed in cells to thereby cause γ-secretase-mediated cleavage reaction. In this case, when γ-secretase acts on the EphA4 endodomain, the EICD-transcription factor fusion molecule migrates into the nucleus and thereby allows enhanced expression of a reporter gene. As a result, EICD production can be quantified.

In the present invention, examples of the above transcription factor include yeast GAL4, heat shock factors, hypoxia inducing factors and so on. Once the EICD-transcription factor fusion molecule has migrated into the nucleus, the transcription factor moiety will act on the response sequence for the transcription factor located upstream of the reporter gene, thereby resulting in enhanced expression of the reporter gene.

In the present invention, examples of such a reporter gene include genes for luciferase, heat stable alkaline phosphatase, GFP (green fluorescent protein) and so on. The expression levels of these reporter genes may be measured using a detector for fluorescence, luminescence or the like, depending on the nature of each reporter gene.

Examples of the above label include biotin labels, radioactive labels, fluorescent labels, chemiluminescent labels and so on. Moreover, modifications may also be made to integrate any detectable moiety in addition to the label. In the present invention, EphA4 in each embodiment may be provided with one or two or more of these labels or modifications.

EphA4 in a preferred embodiment of the present invention is rat EphA4, for example, a polypeptide comprising the amino acid sequence shown in SEQ ID NO: 2. EphA4 in a more preferred embodiment of the present invention is an HA-tagged polypeptide of rat EphA4. For example, it is a polypeptide (SEQ ID NO: 4) further having an HA tag attached to the C-terminal end of rat EphA4. Of course, the whole or a part of the human EphA4 sequence, e.g., the amino acid sequence of SEQ ID NO: 6, 8, 10 or 12 may also be used as in the case of rat EphA4.

The present invention further provides a polynucleotide comprising a nucleotide sequence encoding EphA4 as described above. An example of such a polynucleotide encoding EphA4 is a polynucleotide encoding rat EphA4, for example, the polynucleotide of SEQ ID NO: 1. A polynucleotide encoding EphA4 in a more preferred embodiment of the present invention is a polynucleotide encoding an HA-tagged polypeptide of rat EphA4. For example, it is a polynucleotide (SEQ ID NO: 3) encoding a polypeptide further having an HA tag attached to the C-terminal end of rat EphA4. Of course, the whole or a part of the human EphA4 sequence, e.g., the nucleotide sequence of SEQ ID NO: 5, 7, 9 or 11 may also be used as in the case of rat EphA4.

Although the antibody against EphA4 is not limited in any way as long as it is an antibody capable of recognizing EphA4, preferred is an antibody capable of recognizing the EphA4 endodomain. For example, it is possible to use antibodies described in Tremblay et al., J. Comp. Neurol 501 691-702 or commercially available anti-rat EphA4 antibodies (Upstate, Zymed, Santacruze). Alternatively, those skilled in the art would be able to prepare such an antibody by immunization with an immunogen (antigen) in accordance with existing standard procedures for monoclonal antibody preparation. For example, the antigen is immunized into a non-human mammal, optionally together with Freund's adjuvant. Polyclonal antibodies can be obtained from the serum taken from the immunized animal. On the other hand, monoclonal antibodies are prepared as follows: antibody-producing cells obtained from the immunized animal and myeloma cells having no ability to produce autoantibodies are used to prepare fused cells (hybridomas), and these hybridomas are cloned and screened to select clones which produce monoclonal antibodies having specific affinity to the antigen used for immunization of the mammal. Production of monoclonal antibodies from hybridomas may be accomplished by culturing the hybridomas in vitro or in vivo (e.g., in the peritoneal fluid of non-human mammals, preferably mice or rats, more preferably mice) and then isolating monoclonal antibodies from the resulting culture supernatant or the peritoneal fluid of the mammals. For isolation and purification of monoclonal antibodies, the above culture supernatant or peritoneal fluid may be subjected to saturated ammonium sulfate, euglobulin precipitation, caproic acid method, caprylic acid method, ion exchange chromatography (e.g., DEAE or DE52), affinity column chromatography on an anti-immunoglobulin column or a Protein A column, etc. These monoclonal antibodies also encompass those consisting of heavy chains and/or light chains having amino acid sequences with deletion, substitution or addition of one or several amino acids in the amino acid sequences of the heavy chains and/or light chains constituting the above antibodies.

The method of the present invention allows evaluation of a substance that affects gelatinase-mediated EphA4 processing by incubating gelatinase and EphA4 in the presence or absence of a candidate substance and using the number of spines in spine-forming cells as an indicator.

Namely, the method of the present invention may be accomplished in a cell-based system which allows observation of the processes occurring after contact between gelatinase and EphA4, i.e., gelatinase-mediated cleavage of the EphA4 ectodomain, the subsequent γ-secretase-mediated cleavage of the EphA4 endodomain, production of EICD, and spine formation through intracellular signaling. In this case, an "appropriate cell-based system containing gelatinase and EphA4" and spine-forming cells may be composed of either different or the same cells. The tem "spine-forming cells" is intended to mean cells capable of spine formation, and examples include neurons with excitatory synapses in the central nervous system, etc.

As used herein, the term "spine" refers to a microstructure constituting a chemical synapse, i.e., a thorn-like protrusion (dendritic spine) formed on postsynaptic dendrites (see Hering et al., Nat Rev Neurosci. 2001 December; 2(12):880-8). In general, there are two types of synapses (i.e., dendritic filopodia and dendritic spines) in the mature brain, and it is proposed that spines are involved in the processes of memory and learning because of transition from dendritic filopodia to dendritic spines during memory and learning.

Examples of a preferred cell-based system in this embodiment include primary cultured neurons, cultured cells derived from brain slices, etc. To obtain these cell-based systems, reference may be made to the Example section described later for primary cultured neurons, while cultured cells derived from brain slices may be obtained as follows for the case of hippocampus, by way of example.

The whole brain is taken from a rat at 8 to 9 days of age after birth and introduced into a beaker containing GBSS solution (HBSS (SIGMA)/MEM (Invitrogen)/horse serum (SIGMA)=1:2:1), followed by cooling the whole brain for about one minute. After cooling, the whole brain is collected from the beaker and mounted on a stage. The cerebellum and the rostral half of the cerebrum are cut off, and the remainder is then fixed on the stage with an adhesive. The hippocampus is sliced from the fixed tissue graft. The resulting sections (300 to 400 μm) are each placed on a membrane on a well prepared in advance. The primary cultured cells cultured on the membrane may also be used (see Stoppini, L., Buchs, P.-A. and Muller, D. J. Neurosci. Methods. 37 (1991) 173-182, Gahwiler, B. H. Trends Neurosci. 11 (1988) 484-489, Sakaguti, T., Okada, M. and Kawasaki, K. Neurosci. Res. 20 (1994) 157-164).

Spines to be measured in the present invention are spines on synapses, preferably spines on synapses at the stage of dendritic filopodia or dendritic spines. Such synapses at the stage of dendritic filopodia or dendritic spines are synapses whose morphology is actually observed during memory or learning. Upon measuring spines on these synapses, it is possible to measure spines on synapses in the state of functioning in vivo or on synapses at the stage just before functioning.

For measurement of the number of spines, spines can be detected by using an antibody capable of recognizing a molecule expressed specifically in spines or an antibody capable of recognizing a tagged polypeptide of a molecule expressed specifically in spines, or by using spine-forming cells in which the cells per se are labeled.

In the case of using spine-forming cells in which the cells per se are labeled, spine detection is accomplished by searching for thorn-like protrusions on the spine-forming cells under a microscope capable of detecting the label. An example of a label used for this purpose is EGFP.

In the case of using an antibody capable of recognizing a molecule expressed specifically in spines, examples of such an antibody capable of recognizing a molecule expressed specifically in spines include anti-PSD-95 (Postsynaptic Density-95) antibody, anti-Glutamate Receptor 1 antibody, anti-Actin antibody, anti-Homer antibody, anti-Shank antibody and so on.

Moreover, in the case of detecting a tagged version of a molecule expressed specifically in spines, an antibody against the selected tag may be used. When PSD-95 is selected as a molecule expressed specifically in spines and an EGFP tag is attached to the C-terminal end of PSD-95, an anti-EGFP tag antibody may be used for detection. In this case, it is possible to clarify the presence and concentration of the C-terminal end of PSD-95.

To identify a substance that changes the activity of gelatinase-mediated EphA4 cleavage, each step described above is performed in the presence and absence of a candidate substance, and the spine formation activity in the presence of the candidate substance is compared with the activity in the absence of the candidate substance, whereby a substance that changes the activity of gelatinase-mediated EphA4 cleavage is identified.

Some change in the number of spines in the presence of a candidate substance is indicative of a change in the activity of gelatinase-mediated EphA4 cleavage in the presence of the candidate substance, which means that a substance serving as a modulator for gelatinase activity has been identified. For example, a compound that increases the number of spines in comparison with its control is evaluated as a modulator for the proteolytic activity of gelatinase or as an enhancer for the proteolytic activity of gelatinase. On the other hand, a compound that reduces the number of spines in comparison with its control is evaluated as an inhibitor for the proteolytic activity of gelatinase.

The present invention also comprises a method for evaluating the morphology of postsynapes or the function of neurotransmission using a substance which has been identified as a result of screening. For example, evaluation of the morphology of postsynapes described above may be accomplished by a method for evaluating the number and/or morphology of spines (Pak D et al. Neuron 2001 31. 289-303). Likewise, evaluation of neurotransmission function may be accomplished, for example, by a method for evaluating an electrical change caused on the synaptic membrane using cultured cells or cultured slices (Saura et al., Neuron 2004 42 23-36).

The method of the present invention also comprises any high-throughput screening (HTS) method known to those skilled in the art, in which many candidate substances are tested at the same time (US5876946, US5902732, Jayawickreme and Kost, Curr. Opin. Biotechnol., 8, pp. 629-634, 1997, Houston and Banks, Curt Opin. Biotechnol., 8, pp. 734-740, 1997).

The method of the present invention also comprises the use of known animal models, Compounds selected by the in vitro method of the present invention may be analyzed for their in vivo effects, e.g., by using a non-human model of EphA4 processing. For example, when transgenic mice modified to have the EphA4 gene are administered with a known gelatinase inhibitor, romp-2/9 Inhibitor II, or with a compound selected by the method of the present invention, analysis may be conducted by evaluation of Aβ levels in their brain, cerebrospinal fluid and serum (J. Pharmacol. Exp. Ther. 305, 864-871, 2003), by pathological examination of changes in their brain (e.g., changes in Aβ production, the degree of brain atrophy) arising from changes in their γ-secretase activity, or by evaluation of their survival rate, the amount of their exercise or the amount of their food consumption.

Moreover, the method of the present invention also provides a method for secondary evaluation (screening) of whether or not a test compound affects spine formation by means of a method for evaluating the morphology of postsynapes or the function of neurotransmission. This method may be accomplished in an appropriate cell-based system.

3. Therapeutic Compositions Comprising Substances Obtained by the Method of the Present Invention A substance that promotes the activity of gelatinase-mediated EphA4 cleavage, a salt thereof or a solvate thereof, which is obtainable by the method of the present invention, promotes EICD production, and the EICD in turn promotes spine formation. Thus, the above substance, a salt thereof or a solvate thereof can be expected as an improver for cognitive functions and has the potential to be useful for treatment of, e.g., dementia, particularly AD.

On the other hand, for treatment of diseases associated with excessive formation of synapses, particularly excessive formation of spines, a substance that inhibits the activity of gelatinase-mediated EphA4 cleavage, a salt thereof or a solvate thereof would be useful, As used herein, the term "treatment" is generally intended to mean achieving a desired pharmacological effect and/or a desired physiological effect. For example, in the case of AD, a reduction or amelioration of clinical symptoms or pathological signs is indicative of treatment success.

In the context of the present invention, clinical symptoms of Alzheimer's disease (AD) include progressive disorientation, memory loss and aphasia, eventually leading to disablement, language attrition and akinesia. Pathological signs of AD include, for example, the occurrence of neurofibrillary degeneration, senile plaques and amyloid angiopathy.

Diagnosis of AD in patients may be accomplished by using various known methods. Typically, clinical and pathological evaluations are used in combination for AD diagnosis. For example, the progress or severity of AD may be determined by using Mini Mental State Examination (MMSE) (Mohs et al., (1996) Int Psychogeriatr 8:195-203), Alzheimer's Disease Assessment Scale-Cognitive Subscale (ADAS-cog) (Galasko et al., (1997) Alzheimer Dis Assoc Disord, 11 suppl 2:S33-9), Alzheimer's Disease Cooperative Study-Activities of Daily Living (ADCS-ADL) (McKhann et al., (1984) Neurology 34:939-944), criteria of the National Institute of Neurologic Communicative Disorders and the Stroke-Alzheimer's Disease and Related Disorders Association (NINCDS- ADRDA) (Folstein et al., (1975) J Psychiatr Res 12:189-198, McKhann et al., (1984) Neurology 34:939-944). Further, it is also possible to use any methods which allow estimation of the frequency of senile plaques and/or neurofibrillary degeneration based on evaluation of various regions in the brain (Braak et al., (1991) Acta Neuropathol 82:239-259; Khachaturian (1985) Arch Neuro 42:1097-1105; Mirra et al., (1991) Neurology 41:479-486; and Mirra et al., (1993) Arch Pathol Lab Med 117:132-144).

As used herein, the term "salt" refers to a pharmaceutically acceptable salt, and there is no particular limitation as long as pharmaceutically acceptable salts are formed with the above substances (e.g., compounds). More specifically, examples include halogenated hydroacid salts (e.g., hydrofluoride salt, hydrochloride salt, hydrobromide salt, hydroiodide salt), inorganic acid salts (e.g., sulfate salt, nitrate salt, perchlorate salt, phosphate salt, carbonate salt, bicarbonate salt), organic carboxylic acid salts (e.g., acetate salt, oxalate salt, maleate salt, tartrate salt, fumarate salt, citrate salt), organic sulfonic acid salts (e.g., methanesulfonate salt, trifluoromethanesulfonate salt, ethanesulfonate salt, benzenesulfonate salt, toluenesulfonate salt, camphorsulfonate salt), amino acid salts (e.g., aspartate salt, glutamate salt), quaternary amine salts, alkali metal salts (e.g., lithium salt, sodium salt, potassium salt), alkaline earth metal salts (e.g., magnesium salt, calcium salt) and so on.

A pharmaceutical composition, preferably a therapeutic agent for AD according to the present invention, which comprises a substance (e.g., compound) identified by the method of the present invention may be administered to patients in various modes by either oral route or parenteral route (e.g., intravenous injection, intramuscular injection, subcutaneous administration, intrarectal administration, percutaneous administration). Thus, such a pharmaceutical composition comprising the substance (e.g., compound) of the present invention can be formulated into an appropriate dosage form using a pharmaceutically acceptable carrier in accordance with conventionally used procedures depending on the route of administration, although it can be used alone.

Preferred dosage forms include, for example, tablets, powders, fine granules, granules, coated tablets, capsules, syrups and troches for oral formulations, as well as inhalants, suppositories, injections (including drops), ointments, eye drops, ophthalmic ointments, nose drops, ear drops, cataplasms, lotions and liposomes for parenteral formulations.

Examples of carriers for use in these formulations include commonly used excipients, binders, disintegrants, lubricants, coloring agents, correctives and, if necessary, stabilizers, emulsifiers, absorbefacients, surfactants, pH adjustors, antiseptics, antioxidants, extenders, humectants, surface active agents, dispersants, buffering agents, preservatives, solubilizers, soothing agents and so on. In general, ingredients commonly used as source materials of pharmaceutical preparations may be blended and formulated in a routine manner. Examples of such non-toxic ingredients available for use include animal and vegetable oils (e.g., soybean oil, beef tallow, synthetic glycerides); hydrocarbons (e.g., liquid paraffin, squalane, hard paraffin); ester oils (e.g., octyldodecyl myristate, isopropyl myristate); higher alcohols (e.g., cetostearyl alcohol, behenyl alcohol); silicone resins; silicone oils; surfactants (e.g., polyoxyethylene fatty acid ester, sorbitan fatty acid ester, glycerine fatty acid ester, polyoxyethylene sorbitan fatty acid ester, polyoxyethylene hydrogenated castor oil, polyoxyethylene-polyoxypropylene block copolymer); water-soluble polymers (e.g., hydroxyethylcellulose, polyacrylate, carboxyvinyl polymer, polyethylene glycol, polyvinylpyrrolidone, methylcellulose); lower alcohols (e.g., ethanol, isopropanol); polyhydric alcohols (polyols) (e.g., glycerine, propylene glycol, dipropylene glycol, sorbitol, polyethylene glycol); saccharides (e.g., glucose, sucrose); inorganic powders (e.g., silicic anhydride, magnesium aluminum silicate, aluminum silicate); inorganic salts (e.g., sodium chloride, sodium phosphate); purified water and so on.

Examples of excipients available for use include lactose, fructose, corn starch, sucrose, glucose, mannitol, sorbit, crystalline cellulose, silicon dioxide and so on. Examples of binders available for use include polyvinyl alcohol, polyvinyl ether, methylcellulose, ethylcellulose, gum arabic, tragacanth, gelatin, shellac, hydroxypropylmethylcellulose, hydroxypropylcellulose, polyvinylpyrrolidone, polypropylene glycol-polyoxyethylene block polymer, meglumine and so on. Examples of disintegrants available for use include starch, agar, gelatin powder, crystalline cellulose, calcium carbonate, sodium bicarbonate, calcium citrate, dextrin, pectin, carboxymethylcellulose calcium and so on. Examples of lubricants available for use include magnesium stearate, talc, polyethylene glycol, silica, hydrogenated vegetable oils and so on. Examples of coloring agents available for use include those which are approved to be added to pharmaceutical preparations. Examples of correctives available for use include cocoa powder, menthol, aromatic powder, peppermint oil, borneol, cinnamon powder and so on. The above ingredients may be in the form of their salts or solvates thereof.

For example, oral formulations may be prepared as follows: the substance (e.g., compound) of the present invention is blended with an excipient and optionally with a binder, a disintegrant, a lubricant, a coloring agent, a corrective and so on, and then formulated in a routine manner into, e.g., powders, fine granules, granules, tablets, coated tablets, capsules, etc. In the case of tablets and granules, they may be coated as appropriate with, e.g., sugar coating or other coatings, if necessary. In the case of syrups or injectable formulations, they may be formulated in a routine manner together with, e.g., a pH adjustor, a solvent, an isotonizing agent and so on, optionally in combination with a solubilizer, a stabilizer, etc. Likewise, in the case of external preparations, how to prepare them is not limited in any way and they may be prepared in a routine manner. Base ingredients to be used may be various source materials commonly used for pharmaceutical preparations, quasi drugs, cosmetics and so on, as exemplified by animal and vegetable oils, mineral oils, ester oils, waxes, higher alcohols, fatty acids, silicone oils, surfactants, phospholipids, alcohols, polyhydric alcohols, water-soluble polymers, clay minerals, purified water and so on, optionally in combination with pH adjustors, antioxidants, chelating agents, antiseptic and antifungal agents, colorants, flavorings, etc. If necessary, additional ingredients may further be blended, such as blood flow accelerators, antimicrobial agents, anti-inflammatory agents, cell activators, vitamins, amino acids, moisturizers, keratolytic agents, etc. In these cases, the ratio of the active ingredient to carriers may vary from 1% to 90% by weight. If compounds to be used in the present invention, peptides to be used in the present invention or polynucleotides to be used in the present invention are used for the above treatment, they are preferably purified to at least 90% or more, preferably 95% or more, more preferably 98% or more, and even more preferably 99% or more purity before use.

The effective dose of the pharmaceutical composition of the present invention comprising the substance (e.g., compound) of the present invention will vary depending on, e.g., the severity of symptoms, the age, sex and body weight of a patient, the mode of administration, the type of salt, the detailed type of disease, etc. In general, for adults (body weight: 60 kg), the daily dose for oral administration is about 30 μg to 10 g, preferably 100 μg to 5 g, and more preferably 100 μg to 100 mg, given once or several times, while the daily dose for injection is about 30 μg to 1 g, preferably 100 μg to 500 mg, and more preferably 100 μg to 30 mg, given once or several times. In light of the fact that the efficiency varies depending on the route of administration, it is predicted that the required dose will vary over a wide range. For example, oral administration is expected to require a higher dose than intravenous injection. For administration to children, the dose may be smaller than that for adults. These variations in the dose level can be adjusted by using standard empirical optimization procedures well appreciated in the art.

4. Kits

In the present invention, because of having EphA4 cleavage activity, gelatinase can be used as a cleavage agent for EphA4, particularly for the EphA4 ectodomain, as an enhancer for γ-secretase-mediated cleavage of the EphA4 endodomain fragment, or as a reagent for γ-secretase-mediated EICD production, in order to perform in vitro experiments or non-human animal experiments. In these cases, the present invention can be configured in the form of a kit comprising gelatinase in combination with at least one member selected from a buffer, a cell culture medium, an antibody against EphA4 or a fragment thereof, a fluorescent dye and so on. Such a kit may also comprise an instruction manual which describes, e.g., test procedures for the enzyme activity of gelatinase and nuclear migration of EICD.

The present invention further provides an assay kit for measurement of the level of gelatinase-mediated EphA4 processing (preferably gelatinase-mediated EphA4 cleavage reaction) and an assay kit for measurement of spine formation.

The kits of the present invention each comprise gelatinase or a biological composition containing the same, and a biological composition containing EphA4. The kits of the present invention may comprise a biological composition containing γ-secretase. These kits may further comprise tools for use in immunoblotting and/or Western blotting techniques (e.g., reaction vessels, blotting membranes), reagents (e.g., buffer, culture medium, anti-EphA4 antibody), an instruction manual, etc.

EXAMPLES

The present invention will be further described in more detail by way of the following examples, which are not intended to limit the scope of the present invention.

Example 1

Effects of Gelatinase-Selective Inhibitor on Neuronal Activity-Dependent EphA4 Ectodomain Cleavage Reaction With the aim of identifying proteases which cleave off the EphA4 ectodomain in a neuronal activity-dependent manner, analysis was first performed using a specific inhibitor of gelatinase family molecules (MMP-2, MMP-9) having important functions in the brain. Neurostimulation was performed with 50 μM NMDA, and the inhibitor used was mmp-2/9 Inhibitor II ((2R)-[(4-biphenylylsulfonyl)amino]-N-hydroxy-3-phenylpropionamide, Merck). For detection of cleavage reaction, two types of antibody-based assays were used, i.e., Western blot assay using an antibody capable of recognizing the EphA4 endodomain and ELISA assay using an antibody capable of recognizing the EphA4 ectodomain.

1. Experimental Conditions and Experimental Procedures (1) Culture of Hippocampal Neuronal Cells Hippocampi were isolated from SD rats at 18 days of embryonic age (Charles River Laboratories, Inc.) and provided for culture. More specifically, fetuses were aseptically taken from pregnant rats. From these fetuses, brains were excised and soaked in 20% FBS (Hyclone)/HBSS (SIGMA). From the excised brains, hippocampi were collected under a stereoscopic microscope. The collected hippocampi were each enzymatically treated at 37° C. for 10 minutes in an enzyme solution containing 0.25% trypsin (Invitrogen) and 0.5 mg/ml DNase (SIGMA) to thereby disperse the cells. In this case, the enzymatic reaction was stopped by addition of 20% FBS (Hyclone)/HBSS (SIGMA). The resulting cells were supplemented with 2 ml of HBSS (SIGMA). The cell pellet supplemented with HBSS (SIGMA) was gently pipetted to disperse the cells again. This neuronal cell suspension was diluted with a medium and seeded in a 35 mm dish at an initial cell density of $2 \times 10^5$ cells/dish. The medium used was Neurobasal (Invitrogen) medium supplemented with 1×B27 supplement (Invitrogen) and 0.5 mM L-glutamine (Invitrogen). The seeded cells were cultured in a 37° C. incubator under 5% $CO_2$ and 95% air. After culture for 3 weeks, the medium was replaced with a 50 μM NMDA-containing medium, and after 30 minutes, the cultured solution was collected for use in ELISA. On the other hand, the neuronal cells were collected with PBS and then quantified for their protein levels, and 10 μg aliquots were subjected to SDS-PAGE, followed by Western blotting with an anti-EphA4 antibody capable of recognizing the endodomain.

Experimental Results

Figure 2:
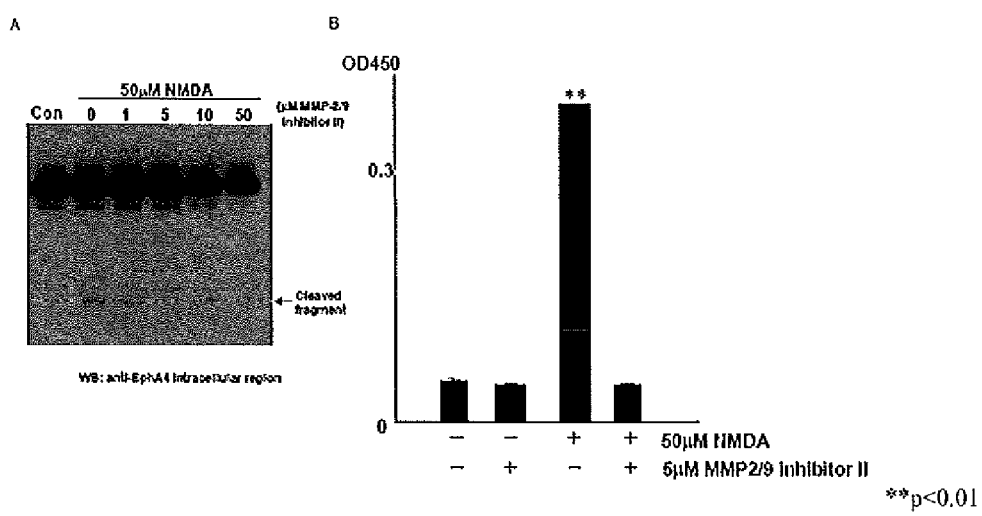
FIG. 2 shows the results of EphA4 ectodomain cleavage reaction.

The results obtained are shown in FIG. 2.

As shown in FIG. 2, when hippocampal neuronal cells were stimulated with 50 μM NMDA, EphA4 cleavage reaction was induced and the EphA4 endodomain fragment was detected. Upon addition of 0 μM, 1 μM, 5 μM, 10 μM or 25 μM mmp-2/9 Inhibitor II in addition to the above stimulation conditions, the cleavage reaction was inhibited in a concentration-dependent manner (FIG. 2A). Moreover, this cleavage event was also detected by ELISA, which had been prepared with an antibody capable of recognizing the EphA4 ectodomain, and was completely inhibited with 5 μM mmp-2/9 Inhibitor II (FIG. 2B). These results indicated that proteases cleaving off the EphA4 ectodomain were gelatinase family molecules (MMP-2, MMP-9).

INDUSTRIAL APPLICABILITY

Compounds that promote gelatinase-mediated EphA4 cleavage reaction are capable of enhancing EICD production, promoting spine formation and exerting an improving effect on cognitive functions. Thus, assay systems which allow detection or quantification of MMP2/9-mediated EphA4 cleavage reaction are useful for screening of cognitive function improvers.

SEQUENCE LISTING (112 sequences)

SEQ ID NO: 1 - DNA, 2961 bp, Rattus norvegicus
  CDS (1)..(2958)
atggctgggattttctatttcatcctcttttcgtttctctttggaatttgcgacgctgtcaccggttctagggtatacccggcgaatgaagttactttattggattccagatctgttcagggagagcttgggtggatagcaagccctctggaaggagggtgggaggaagtaagcattatggatgagaaaaatacaccgatccgaacctaccaggtatgcaacgtgatggaagccagtcagaacaactggctgcgaactgactggatcacccgagaaggggcgcagagggtgtacattgaaattaagttcactctgagggactgcaacagtcttccgggcgtcatggggacttgcaaggagacgtttaacctttactactatgaatcggacaacgacaaggagcgcttcatcagagagagccagttcggcaagatcgacaccatcgcagcggatgagagctttacacaggtggacattggggacagaatcatgaagctcaacaccgagatccgggatgtagggcccctgagcaagaagggtttttacctggcttttcaggatgtgggtgcttgcatcgccctggtgtctgttcgtgtgttctacaagaagtgtcccctcaccgttcgaaatctagcccagttccccgataccatcactggggctgatacctcttccctggtggaagttcgaggctcctgtgtcaacaactcagaagagaaggatgtgccaaaaatgtactgtggggcagatggtgaatggctggtacccattggcaactgcctatgcaatgctgggcacgaggagcagaatggtgaatgccaagcttgcaaaattggatattacaaagctctctccacggacgccacctgtgccaagtgtccaccgcacagctactctgtctgggaaggagccacgtcctgcacctgtgaccgaggctttttcagagctgacaacgatgccgcgtccatgccctgcacccgcccaccatctgctcccctcaacttgatttctaatgtcaacgagacgtcggtgaacttggaatggagcagtcctcagaacacaggtggccgtcaggacatttcttacaacgtggtctgcaagaaatgtggagctggggatcccagcaagtgtcgaccctgtggaagtggagtccactacacgccacagcagaatggactcaagacgaccagagtctccatcactgacctcctagcacacaccaattacacgtttgagatctgggcagtgaatggcgtgtctaagtacaaccctagcccagaccagtcagtgtctgtcacagtgacaaccaaccaagcagcaccatcatccattgctttggtccaggctaaagaagttacaagatacagtgtggctctggcttggctggaaccagatcgaccaaacggagtcatcttagaatatgaagtgaaatattatgaaaaggatcagaatgaacgaagctatcgcatagttcggacagctgccaggaacacagatatcaaaggcctgaaccctttgacttcttacgtcttccacgtgcgagccaggaccgccgctggctatggagacttcagcgaacccttggaagtcactaccaatacagtgccttcccgaatcattggcgacggggccaactctaccgtcctgctggtctccgtctctggcagtgtagtactcgtggtcattctcattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtacttatctgatatgagctatgtgcatcgagacctggctgccaggaacattctggtaaacagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 2 - protein, 986 aa, Rattus norvegicus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 3 - DNA, 3000 bp, Rattus norvegicus
  CDS (1)..(2997)
atggctgggattttctatttcatcctcttttcgtttctctttggaatttgcgacgctgtcaccggttctagggtatacccggcgaatgaagttactttattggattccagatctgttcagggagagcttgggtggatagcaagccctctggaaggagggtgggaggaagtaagcattatggatgagaaaaatacaccgatccgaacctaccaggtatgcaacgtgatggaagccagtcagaacaactggctgcgaactgactggatcacccgagaaggggcgcagagggtgtacattgaaattaagttcactctgagggactgcaacagtcttccgggcgtcatggggacttgcaaggagacgtttaacctttactactatgaatcggacaacgacaaggagcgcttcatcagagagagccagttcggcaagatcgacaccatcgcagcggatgagagctttacacaggtggacattggggacagaatcatgaagctcaacaccgagatccgggatgtagggcccctgagcaagaagggtttttacctggcttttcaggatgtgggtgcttgcatcgccctggtgtctgttcgtgtgttctacaagaagtgtcccctcaccgttcgaaatctagcccagttccccgataccatcactggggctgatacctcttccctggtggaagttcgaggctcctgtgtcaacaactcagaagagaaggatgtgccaaaaatgtactgtggggcagatggtgaatggctggtacccattggcaactgcctatgcaatgctgggcacgaggagcagaatggtgaatgccaagcttgcaaaattggatattacaaagctctctccacggatgccacctgtgccaagtgtccaccgcacagctactctgtctgggaaggagccacgtcctgcacctgtgaccgaggctttttcagagctgacaacgatgccgcgtccatgccctgcacccgcccaccatctgctcccctcaacttgatttctaatgtcaacgagacgtcggtgaacttggaatggagcagtcctcagaacacaggtggccgtcaggacatttcttacaacgtggtctgcaagaaatgtggtgctggggatcccagcaagtgtcgaccctgtggaagtggagtccactacacgccacagcagaatggactcaagacgaccagagtctccatcactgacctcctagcacacaccaattacacgtttgagatctgggcagtgaatggcgtgtctaagtacaaccctagcccggaccagtcagtgtctgtcacagtgacaaccaaccaagcagcgccatcatccattgctttggtccaggctaaagaagttacaagatacagtgtggctctggcttggctggaaccagatcgaccaaacggagtcatcttagaatatgaagtgaaatattatgaaaaggatcagaatgaacgaagctatcgcatagttcggacagctgccaggaacacagatatcaaaggcctgaaccctttgacttcttacgtcttccacgtgcgagccaggaccgccgctggctatggagacttcagcgaacccttggaagtcactaccaatacagtgccttcccgaatcattggtgatggggccaactctaccgtcctgctggtctccgtctctggcagtgtagtactcgtggtcattctcattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtcgcggccgcagactacccatacgacgtcccagactacgcttag

SEQ ID NO: 4 - protein, 999 aa, Rattus norvegicus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPVAAADYPYDVPDYA

SEQ ID NO: 5 - DNA, 2961 bp, Homo sapiens
  CDS (1)..(2958)
atggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 6 - protein, 986 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 7 - DNA, 2850 bp, Homo sapiens
  CDS (1)..(2847)
atggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccatgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggtcattaaaatggaccggtataaggataacttcacagctgctggttataccacactagaggctgtggtgcacgtgaaccaggagtaa

SEQ ID NO: 8 - protein, 949 aa, Homo sapiens [sequence omitted]

SEQ ID NO: 9 - DNA, 6364 bp, Homo sapiens
  CDS (43)..(3003)
ctgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtgtgtatgcgtgcctgtctgtgtgcgggtgtgtgtatgtgcatagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaaaaaaaaaaaaaaaaaa

SEQ ID NO: 10 - protein, 986 aa, Homo sapiens; identical to SEQ ID NO: 6

SEQ ID NO: 11 - DNA, 3017 bp, Homo sapiens
  CDS (57)..(3017)
aagcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcgtcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 12 - protein, 986 aa, Homo sapiens [sequence omitted]

SEQ ID NO: 13 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 14 - protein, 986 aa, Mus musculus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 15 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaatgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 16 - protein, 986 aa, Mus musculus; identical to SEQ ID NO: 14

SEQ ID NO: 17 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagactgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgacaccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 18 - protein, 986 aa, Mus musculus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKTDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 19 - DNA, 2784 bp, Mus musculus
  CDS (1)..(2781)
atggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactattatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggatgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagtcctcagaacacaggtggccgtcaggacatttcttacaacgtggtctgcaagaaatgtggagctggtgatcccagcaaatgccggccctgtggaagtggagtccactacacaccacagcagaacggactcaagacgaccagagtctccatcactgacctcctagcacacaccaattacacgtttgagatctgggcagtgaatgaagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctcttacttcctatgttttccacgtgcgagccaggaccgctgctggctacggagacttcagcgagcccctggaagtcactactaatacagtgccttcccgcatcattggcgatggagccaactccactgtcctgctggtctctgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaatcgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagcgacaggcctaaatttgggcagatcgttaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 20 - protein, 927 aa, Mus musculus
MDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNEVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 21 - DNA, 1725 bp, Mus musculus
  CDS (1)..(1722)
cgaaccatggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggcccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaaggtaa

SEQ ID NO: 22 - protein, 574 aa, Mus musculus
RTMAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALAQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRR

SEQ ID NO: 23 - DNA, 3544 bp, Mus musculus
  CDS (150)..(2933)
tttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactattatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggatgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagtcctcagaacacaggtggccgtcaggacatttcttacaacgtggtctgcaagaaatgtggagctggtgatcccagcaaatgccggccctgtggaagtggagtccactacacaccacagcagaacggactcaagacgaccagagtctccatcactgacctcctagcacacaccaattacacgtttgagatctgggcagtgaatgaagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctcttacttcctatgttttccacgtgcgagccaggaccgctgctggctacggagacttcagcgagcccctggaagtcactactaatacagtgccttcccgcatcattggcgatggagccaactccactgtcctgctggtctctgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaatcgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagcgacaggcctaaatttgggcagatcgttaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctgagccagtaccgaatagactcaaaactctcgaatagtttacctcatccatgcactttaattgaagaactgcactttttttactttgtcttcgccctctgaaattaaaggaaaacaaacaaacaaaaaacaaaaacaaaaatatctgcagcgttgcttggtgtaagagattgctgaaaccatggggcttataatgaatgaccttgatcatcagaattaaacctggagccagtaatttctcagaagaactctgtccatcgctggtgtgtaaaatacatgtacttatataaataaaactctgcctctgagtttcgatgctgtatttcccgtcagatactcggcttttcaagtcaccctaatcctttctctgtctggaatttcaagggaaggatttcatctgtggcattaataacagtcatcactccttaccagaaagaagacctgctgtgcccaggagcactgttaaaggactcaatggtggctttcagggctcggtttataccacagaagaaaatccaggtgaaagccacttggcccattcatgctgcctcttcagtggccaggacacctagtggatttttatgacaaagggggggttagaaaaaaaaaaaaaaa

SEQ ID NO: 24 - protein, 927 aa, Mus musculus; identical to SEQ ID NO: 20

SEQ ID NO: 25 - DNA, 6328 bp, Mus musculus
  CDS (58)..(3018)
taagcatttattccactgggatagaagcggcaggagcagcgttggcaccggcgaaccatggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctgagccagtaccgaatagactcaaaactctcgaatagtttacctcatccatgcactttaattgaagaactgcactttttttactttgtcttcgccctctgaaattaaaggaaaacaaacaaacaaaaaacaaaaacaaaaatatctgcagcgttgcttggtgtaagagattgctgaaaccatggggcttataatgaatgaccttgatcatcagaattaaacctggagccagtaatttctcagaagaactctgtccatcgctggtgtgtaaaatacatgtacttatataaataaaactctgcctctgagtttcgatgctgtatttcccgtcagaggcttttcaagtcaccctaatcctttctctgtctggaatttcaagggaaggatttcatctgtggcattaataacagtcatcactccttaccagaaagaagacctgctgtgcccaggagcactgttaaaggactcaatggtggctttcagggctcggtttataccacagaagaaaatccaggtgaaagccacttggcccattcatgctgcctcttcaatggccaggacacctggtggatttttatgacatagggggggttagaaagaaaagaaaatggatttttaaaacatgcgaactcccaagacctattaaccctaactggacaaatgaggtctctttggggctgaggctgtgccatataaagtcttctttgagaatgctacaaacttctcataactaccttatggatagtgggctgagacaatcctgaatggagaattttcacacacacacacacacaccccttcaaagaggcaactcccaaatttacaagggaatagattctggtatctcagcctcacagcccttcctgttgattacataagcgcttggaagaaaatagaacacaccctccaccgttccttctgaatgtttttctttggcttctcttctgccggtttttgaggcaaagacacgacaaaacacctgcacctgaacagcagaagaaatgtgtcaagtccccttcgcccaggaaaacgacatccagctttggcatctgttctcagctgcactgaggaatgtgctgtctcgaggcaccagctctgcagagcccttgctcccaaactccttgtggttttatttatacgtatttccatatttcattcctgtacggccccgctgcatccgtgtggcagcaagtgaccatatgttacaggttttactatggacgccaggtcaggcgccaccacgcagaacaaagccagttccgcaagctgcctccgatacgcaatgctaaagtgacattttacccagggtgtgccattgcagtgatataaatatatttttttcctagactaaaatatgacctgaatatctcttttgatgtgtgtacatagagtgtgtgtgtgtgtgtgtgtgtgtgtgtgtatgtgagtgtgtatggggtgtgtgtgtgtgtgtgtgtgtgtgtgtgtaacctcatgcttagaactgcctgtgaatgttgtggaatgctatacctggagagttctggtttattaccagttcaaagataaggaaagagtcacatgatatacaagacccggagaccatgtccgtccccttgggaagacagcttggaaacgctacatgttctttatctgtaagtgtaatgtgtctgtcacattcatcctaagaagcagttctttggacagatgttttcaccttgatggtggaatgatttttagatataagcctgactcgccgatttcacaatggagagagaaggggatggaatccaatttgtgaccccagatggagtataagtcgcctttgtttccctgcataaatgaacttgttgaatgcgaacaaatatatgcaattcatatacttttggaagatgaacttaagatatgtgtgtcagccttgagatgatgtgtctggagtaatactttgtgtcccagtgtcacagaaaaatacatacatgccagtggctcttgaggttaatgtagttgggatgaaatggcctctagcaattccaggttccccaattacatgtggaaagttctggtaattaatatgcagctaactacttatgcccttgaaagtataccagtcttctagaatcggagttctggtgtatgaagattcagtatcgacaggatatgtataccaaactccagccagcatactgccattttacttaacctgagaggctgccttgcttattctgagctatggtcacagaaactgtggccatttatataagctataacatcaaatcagggaattagaaaaaaaaaaaacggggaaaagattctgaaccatatattgttgaataagtaaagaaaatcaccaataaatatttattgcattctgacagggtgtatggcattgtattctcataactatgccagagtgacaaagttatttcaccccttttgaggggaccttaatatatttttaaagggatgtgcctatgcattgatgcctgaaaaataggtgtaaaaaaaaaaaaaaagatgaacctctgagtgcatcatctttcccagaggtcaggtgggaggaggtcaacttctgggtctgtgtccagcccaggagcaagcgctggccttgggagctggaaggctaaaatctagtcaaatctactaaacagctttgagctgttccctgcaccaaatcaagccgtttcaccacgtgtctgcaggctctgaggtttttattttttggcgatcttctaaatgaaatgttctggtgtgttttaaagactagaggaaaggttgtgttcacaacatgattactgtgtgtgttctgagacctcttgtattcatctgtgaaggggacgtgtattaatccatacactcctatagcctcgactatttgtctgaagacacttaaattttgaccagtaaaggaaagttctagaagcaatattttcactcctttagcattgtccaaataacatcaagtattaataaacgctgaagagtgtatttattttgtattactccaagtctgttggaatatgcaaggactgtggttataattagaatgtataaggcatattataatttagttcattctgaaaaagaagttagctgaacatctcttggttcatacatgttccaaattttgaacaatcttttgagttagccatagatttttctattttgtttttatttgtcaaggtatttttttcttcccttcatgaactttaggtacacataacttatgtcatttatttatggtcttttatacctagtttgtaaagttgtaaaatagcaaactaaatgcaaagagtttgcatttgaaagtaataaagtagttgccgtatacaaacctg

SEQ ID NO: 26 - protein, 986 aa, Mus musculus; identical to SEQ ID NO: 14

SEQ ID NO: 27 - DNA, 2961 bp, Monodelphis domestica
  CDS (1)..(2958)
atggctgggattttatatttcattctcttttcgtttctatttgggatttgcaatggtgtcaccggttctaggatatatcccgccaatgaagttactttattggattccagatcggttcagggagaacttgggtggatagccagccctttggaaggagggtgggaagaagtgagcattatggatgagaaaaatactccaatccgtacctaccaagtctgcaatgtgatggagtccagccaaaacaactggttacgaactgattggattcctcgggaaggggctcagagggtgtatatcgagattaaattcacactgagggactgcaatagcctaccaggagttatgggaacttgcaaagagacttttaacttgtactactatgaatccaacaatgataaagaacgctttattagagagagccagtttgccaagatcgacaccattgctgctgatgagagcttcacccaagtggacattggtgacagaatcatgaagttgaacactgagatacgagatgtgggaccattgagtaagaaagggttctatttggcttttcaagatgttggagcttgtattgccctagtatctgttcgggttttctataagaagtgcccattgacagttcgcaatctggctcaatttccagacaccatcactggggctgatacatcctccctagtggaagttcgaggctcttgtgtcaacaactcagaagagaaggatgtgccaaaaatgtattgtggggcagatggtgaatggctggtacccattggcaactgtctatgcaatgctgggcatgaagagagaaatggagaatgccaagcctgcaagattggatactataaggccctttccactgatactgcctgtgccaagtgcccaccccacagctactccgtctgggagggatccacctcctgcacctgtgaccgaggctattttcgagcagaggatgatgcggcttccatgccctgcactcgcccaccatctgctcccctcaacttgatttcgaatgtcaatgaaacatcagtgaacttggagtggagcagtcctgagaacactgggggccgtcaagacatttcctacaacgtagtgtgcaagaagtgtggtgctggagaggtcaaccgatgtggatcctgcggcagtggagtccactatacaccccagcagaatggcctcaagagcaccaaagtctccatcaccgacctcctggcacatactaactatacttttgaaatcttggctgtgaatggagtgtccaagtacaatccgagtcaggaccaatcagtttcagttactgtgacgacaaaccaagcagctccgtcttccatcgctttgatccaggctaaagaaataacgagatacagtgttgcattggcttggctggaacctgatcggccaaatggagtcatcttagagtatgaagtcaaatattatgagaaggatcagaatgaacgcagctataggattgttcgaacagcctccaggaacactgacatcaaaggcttgaatcccttgacttcctatgtattccatgtgagagcccgaacagcagctggctatggagacttcagtgaaccctttgaggtcacaactaacacagtgccttctcgaatcattggagatggaaccaactccacagtccttctggtgtccgtttcgggcagcgtggttctggtggtcatcctcattgcagccttcgtcatcagccggagacggagtaaatacagtaaggcaaagcaggaagcagatgaagagaaacatttgaatcaaggtgtgagaacctatgttgacccttttacatatgaagatcccaaccaagctgttcgagagtttgccaaagaaattgatgcctcctgcattaagatagaaaaagttataggagtgggtgaatttggtgaagtgtgcagtgggcgactcaaagtacctgggaagagagagatctgtgtggctattaagactcttaaagctgggtatacagacaaacagaggagggatttcctaagtgaagccagcatcatgggacagtttgaccacccaaatatcatccacttagaaggcgtagttaccaaatgtaaacctgtaatgatcataaccgagtacatggagaatggctccttggatgcattcctgaggaagaatgatggaagatttacagtgattcagttggttgggatgcttcgtggcattggttctgggatgaaatacctctctgatatgagctatgtgcatagagatctagctgcccggaacatcttggtcaatagcaacttggtctgcaaagtatctgactttggcatgtctcgtgttcttgaagatgatcctgaagcagcttacacaaccaggggtggcaagattcccatccggtggactgcaccagaagcgattgcttatcgtaaattcacatccgcgagtgatgtatggagctatggaattgtgatgtgggaagtgatgtcgtatggagagcggccttactgggatatgtccaaccaggatgttataaaagccattgaagaaggctaccggctacctccaccaatggactgccccatcgctctccaccagctgatgctagactgctggcagaaggaaagaagtgacagacctaaatttggacagattgtcaacatgttggacaaactcattcgcaaccccaacagcttgaagaggacgggtactgagagctccaggcccaatactgctctgttggatcctagctctcccgagttctctgctgtggtatctgtaggtgattggcttcaggccattaaaatggaccggtataaggacaacttcacagctgccggttacaccaccctcgaggctgtggtgcacatgaaccaggacgacctggcgagaatcggtatcacggccgtcacgcaccagaataagatcttgaacagcgtccaggcaatgcggacccaaatgcaacagatgcatggcaggatggttcctgtctga

SEQ ID NO: 28 - protein, 986 aa, Monodelphis domestica
MAGILYFILFSFLFGICNGVTGSRIYPANEVTLLDSRSVQGELGWIASPLEGGWEEVSIMDEKNTPIRTYQVCNVMESSQNNWLRTDWIPREGAQRVYIEIKFTLRDCNSLPGVMGTCKETFNLYYYESNNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDTACAKCPPHSYSVWEGSTSCTCDRGYFRAEDDAASMPCTRPPSAPLNLISNVNETSVNLEWSSPENTGGRQDISYNVVCKKCGAGEVNRCGSCGSGVHYTPQQNGLKSTKVSITDLLAHTNYTFEILAVNGVSKYNPSQDQSVSVTVTTNQAAPSSIALIQAKEITRYSVALAWLEPDRPNGVILEYEVKYYEKDQNERSYRIVRTASRNTDIKGLNPLTSYVFHVRARTAAGYGDFSEPFEVTTNTVPSRIIGDGTNSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQDDLARIGITAVTHQNKILNSVQAMRTQMQQMHGRMVPV

SEQ ID NO: 29 - DNA, 3084 bp, Canis familiaris
  CDS (1)..(3081)
atgggaaagatcggaaagtcatccatcatgcccgtgacatacatcacacccaacaacagcccaaagccacgagatgtcacgcccgcgggacagattcactcggtgacaggcagtgacagtcagagcccaacaaggatgccagtgccaccagatgttgccgaagctcataaactgggtcagcacaaccacgctgttgcaagaggttccgaacaaataaccttattggattccagatctgttcagggagaacttgggtggatagcgagccctctggaaggagggtgggaggaagtgagtatcatggatgaaaaaaacacaccaatccgaacctaccaagtgtgcaacgtgatggaacccagccagaataactggctccgaactgattggatcacccgagaaggggcgcagagggtgtacattgaaatcaagttcacattgagagactgcaacagccttccaggtgtcatgggcacttgcaaggagacgttcaacctctactactatgaatcagacaacgacaaagagcgttttatccgagagagccagtttgccaagattgacaccatcgctgctgacgagagcttcacccaggtggacattggtgacaggatcatgaagctgaacaccgagatccgggatgtagggccgttgagcaaaaaggggttttatctggcttttcaggatgtgggggcttgcatcgccctggtgtcagtccgtgtgttctataagaagtgtccgctcaccgtccgcaatctggcccagtttccagacaccatcacgggggctgatacgtcttccctggtggaggttcgaggctcctgtgtcaacaactcagaagagaaggatgtgccaaaaatgtactgtggggcagatggtgaatggctggtacccattggcaactgcctatgcaatgctgggcacgaagagcgaaatggagaatgccaagcctgcaaaattgggtattacaaggccctctccacggatgcggcctgtgccaagtgcccgccccacagctattcggtctgggaaggagccacatcgtgtacctgtgaccgaggctttttcagagccgacaacgacgccgcctccatgccctgcacccgcccaccgtctgctcccctcaacctgatttcaaatgtcaacgagacttcggtgaatttggaatggagcagtccccagaacacaggtggccgccaggatatttcctacaatgtggtgtgcaagaaatgtggagctggtgattccagcaagtgccgaccctgtggaagtggggtccactataccccacagcagaatggcctgaagaccaccaaagtttccatcactgacctcctggctcacaccaattacaccttcgaaatctgggcggtgaatggagtgtccaagtacaaccccagcccagaccaatcagtgtccgtcactgtgacgaccaaccaagcagcaccatcatccattgccttggtccaggcgaaagaagttacaagatacagtgttgctctggcttggctggaaccagatcggcccaatggggtgatcttggagtatgaagtcaagtattatgagaaggatcagaatgagcgaagctaccggattgtccggacggccgccaggaacacagatatcaaaggcctgaatcctctgacttcctacgtgttccatgtccgagccaggacagcagctggctacggcgacttcagcgagcccctggaggtcacaaccaacacagtgccttcccggatcatcggagatggggccaactccacggtccttctggtctcagtctcaggcagtgtggtgctggtggtcattctcatcgcggcctttgtcatcagcaggagacggagtaaatacagtaaagctaaacaagaagcagatgaagagaaacatttgaatcaaggtgttagaacttatgtggatccctttacatatgaagatcccaaccaagcagttcgagaatttgccaaagaaatcgacgcctcctgcattaagattgaaaaagtcataggagttggtgaatttggcgaagtatgcagcgggcgtctcaaagtgcctggcaagagagagatctgtgtagccatcaagacactgaaagctggttatacagacaaacagaggagagacttcctgagtgaggccagcatcatgggacagtttgaccacccgaacataattcacttggaaggcgttgtcaccaaatgtaaaccagtaatgatcataacagagtacatggagaatggctccttggatgcattcctcaggaagaatgatggcagatttactgtcattcagctggtgggcatgcttcgtggcatcgggtctgggatgaagtacttatctgatatgagctatgtgcatcgagatctagctgcacggaacattctggtcaatagcaacttggtctgcaaagtgtctgattttggcatgtcgcgagtgcttgaggatgatccggaagcagcttacaccaccaggggtggcaagattcctatccggtggaccgcgccagaagcaattgcctatcgtaaattcacatcagcgagtgatgtatggagctatggaatcgttatgtgggaagtgatgtcgtatggagagagaccctattgggatatgtccaatcaagacgtgattaaagccattgaggaaggctatcggctcccccctccaatggactgccccatcgccctccatcagctgatgctagactgctggcagaaggagagaagtgacaggccgaaattcgggcagattgtcaacatgttggacaaactcatccgcaaccccaacagcttgaagaggacgggaactgagagctccagacctaacactgccttgttggacccaagctcccctgaattctccgccgtggtatcagtgggcgattggctccaggccattaaaatggaccgatataaggataacttcacggctgctggttataccacactagaggctgtagtgcacatgaaccaggaggacctggcgaggatcggcatcacggccgtcacacaccagaacaagattttgagcagcgtccaggcgatgagaacccaaatgcaacagatccacggcaggatggttcccgtctga

SEQ ID NO: 30 - protein, 1027 aa, Canis familiaris
MGKIGKSSIMPVTYITPNNSPKPRDVTPAGQIHSVTGSDSQSPTRMPVPPDVAEAHKLGQHNHAVARGSEQITLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDAACAKCPPHSYSVWEGATSCTCDRGFFRADNDAASMPCTRPPSAPLNLISNVNETSVNLEWSSPQNTGGRQDISYNVVCKKCGAGDSSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQEDLARIGITAVTHQNKILSSVQAMRTQMQQIHGRMVPV

SEQ ID NO: 31 - DNA, 2961 bp, Pan troglodytes
  CDS (1)..(2958)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 32 - protein, 986 aa, Pan troglodytes; identical to SEQ ID NO: 6

SEQ ID NO: 33 - DNA, 2964 bp, Pan troglodytes
  CDS (1)..(2961)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggttgggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 34 - protein, 987 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRLGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 35 - DNA, 2784 bp, Pan troglodytes
  CDS (1)..(2781)
atggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 36 - protein, 927 aa, Pan troglodytes [sequence omitted]

SEQ ID NO: 37 - DNA, 2907 bp, Pan troglodytes
  CDS (1)..(2904)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggacagtgtccaggcaatgcgaacccaaatgcagcagatgcacggcagaatggttcccgtctga

SEQ ID NO: 38 - protein, 968 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 39 - DNA, 3015 bp, Pan troglodytes
  CDS (1)..(3012)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacaggtaacaaggaccacccagactcagtcacttctgagctaatttttgtatgtttagctgtagtcactggggtctctgttttgctaagttggttcctgctttgcaaacaacggagtaaatacagtaaagccaaacaagaagcggatgaagagaaacatttgaatcaagctccgcctccctggttcacaccattctcccacctcagcctcctgagtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccaggcaagtggtgactcacttaaattcctgccttttcatcagaggccacttcatggctctctgcaacctgggtgtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 40 - protein, 1004 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTGNKDHPDSVTSELIFVCLAVVTGVSVLLSWFLLCKQRSKYSKAKQEADEEKHLNQAPPPWFTPFSHLSLLSVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRQVVTHLNSCLFIRGHFMALCNLGVGDWLQAIKMDRYKDNFTAAGYTTLEAVVHVNQEDLARIGITAITHQNKILSSVQAMRTQMQQMHGRMVPV

SEQ ID NO: 41 - DNA, 2958 bp, Pan troglodytes
  CDS (1)..(2955)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagctagaccttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagaagagggaagtagcttgcagcggctcatgcacactcagccaattcttctcctcacgccggttgtctgctctgttatctcggactataaatgtttaaatgggacaagaacaggtgaacagagaggagacaggtatattcagccaacttatcatgtttatcactcaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggttgggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 42 - protein, 985 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQARPCKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKNERSYRIVRTAARNTDIKGLNPLTSYVFHVRARTAAGYGDFSEPLEVTTNTEEGSSLQRLMHTQPILLLTPVVCSVISDYKCLNGTRTGEQRGDRYIQPTYHVYHSGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRLGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 43 - DNA, 2961 bp, Macaca mulatta
  CDS (1)..(2958)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 44 - protein, 986 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 45 - DNA, 2907 bp, Macaca mulatta
  CDS (1)..(2904)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggacagcgtccaggcaatgcgaacccaaatgcagcagatgcacggcagaatggttcctgtctga

SEQ ID NO: 46 - protein, 968 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 47 - DNA, 2925 bp, Macaca mulatta
  CDS (1)..(2922)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtccccacagggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 48 - protein, 974 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSPQGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 49 - DNA, 2979 bp, Macaca mulatta
  CDS (1)..(2976)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 50 - protein, 992 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 51 - DNA, 3036 bp, Macaca mulatta
  CDS (1)..(3033)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttttttcctgctgccattcaggtgatcagcctctgatgtcattagctgtcgtcactggagtctctgttttgctaagttgtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 52 - protein, 1011 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFFSCCHSGDQPLMSLAVVTGVSVLLSCKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 53 - DNA, 2970 bp, Macaca mulatta
  CDS (1)..(2967)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagaatcatttaaatcaaatggggccaactccacagtccttctggtctctgtctcaggcagtgtggtgctggtggtaattctcattgcagcttttgtcatcagccggagctgccagtatagaacaacacattctgtacaggcatctattttacattgtccaacttatcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 54 - protein, 989 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTESFKSNGANSTVLLVSVSGSVVLVVILIAAFVISRSCQYRTTHSVQASILHCPTYHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 55 - DNA, 3750 bp, Macaca mulatta
  CDS (172)..(2955)
aaaattcaagccagtgatatcctaggggtggaagacgagtctctgatggtccccaacacatcttgagaaagagagactacttgagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctgagccagtactgaataaactcaaaactcttgaaattagtttacctcatccatgcactttaattgaagaactgcactttttttacttcgtcttcgccctctgaaattaaagaaatttaaaaaaatgtctgcagcgttgcttggtgtacagattgctgaacctgtggggcttacagaaatgactgccggtcatctgaattagacctggaacaaatcgtttctcagaagtacttttctgttcatcaccagtctgtaaaatacatgtacctatagaaatagaacactgcctccgagttttgatgctgtatctgctgccggacactgagcttctgagacatccttgattctctttccatgtggaattacaaccattgtattttgtttgtggcataaattacagtcatctctctttcactggaatgaagaccatgcccaggaacatgttttaaggactcagctgtggcttttagggcttggttcataccatgggggaaaaaacatcctaggagaaagcgacgtggctcattagtgttgcctcttcagtgctcaagccacctggtgaattcctatgacgcagggggctggaaagaaagggaaagtggatttaaaaaaaaaaaatatatatatatatatacaaaaaaccaagccccataatccctaactggacaaatgaggtctgtttctttgggcctgaggctgtgccatataaagtcttattttaggactctacaaacttgtcctatcttatggatagtgggctgtgacaatctggaatagagaacgttcacacttcgctcct

SEQ ID NO: 56 - protein, 927 aa, Macaca mulatta
MDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 57 - DNA, 2961 bp, Gallus gallus
  CDS (1)..(2958)
atggccggggtccccgtcggcgcgctcctcccgctcctcgtcggcgtctgcggggccgtcaccggctcccgcgtgtaccccgccaacgaagtgaccctgctggactcccgctcggtgcagggggagctgggctggatcgcgagcccgctggaaggagggtgggaggaagtgagcataatggatgagaagaacactccgatccgcacctaccaagtttgcaatgtgatggagcccagtcagaataattggttacgaactgattggattccccgcgagggggctcagagggtatatattgaaatcaagttcacgctgagagactgcaacagcctgccaggtgtcatgggaacttgcaaagagactttcaacctctattactatgaatcaaacaacgacaaggagcgttttattcgagagagccagtttgccaagattgacaccattgctgctgatgagagcttcacccaggtggacattggtgacaggatcatgaagctgaatacagaggtgcgggacgtggggcctctcagcaagaaagggttttacttggctttccaggacgtcggtgcctgcattgctttggtgtctgttcgtgtcttctataagaagtgcccactgacagttcgaaacctggcacagtttccagacaccattactggggctgatacatcctctctggtggaggttcgtggctcctgtgtcaacaactcggaagagaaggacgtgccaaaaatgtactgcggggcagatggtgaatggctggtacccattggcaactgtctgtgcaatgctggctatgaagaacgcaatggtgaatgccaagcttgcaaaatcggatactacaaggcgctctcaacagatgttgcatgtgccaaatgcccgcctcacagctactccatctgggaaggctctacctcctgcacctgtgatcggggcttcttccgagcagaaaatgatgctgcatccatgccctgcactcgccctccatccgcaccccagaacctgatttccaacgtcaacgagacgtcagtgaacttggagtggagcgccccacagaacaagggaggacgggacgacatctcctacaacgtggtgtgcaagcgctgcggggcaggggagcccagccactgccggtcctgtggcagtggtgtacatttcagcccccagcagaacgggctgaaaaccacgaaggtttccatcactgacctcctggcacacaccaactacacctttgaggtctgggcagtgaatggagtgtccaagcacaaccccagccaggaccaagctgtgtcagtcactgtgacaactaaccaagcagctccatccccaattgcattgatccaggctaaagagataacgaggcacagcgttgccttggcctggctggaacctgacaggcccaatggagtcatcctggagtatgaagtcaagtactatgaaaaggaccaaaacgagcgcagctatcgcattgtgaagacagcctccaggaatactgacatcaaaggtttgaaccccctgacttcatatgtatttcatgtgcgggccaggacagcagcaggatacggagacttcagtgggccgtttgagttcacaactaacacagttccttcccccatcattggcgatggtaccaatcccacagtgctgcttgtttcagtggctggcagtgttgttctcgtggtcattctcattgcagcctttgtcatcagcaggaggcgcagcaaatacagtaaagctaagcaagaggcagatgaggagaaacatttgaaccaaggtgtcagaacatatgtggatccttttacatatgaggatccaaatcaagctgtgagggaatttgccaaagaaattgatgcctcctgcataaagattgagaaagttattggtgtgggggaatttggtgaagtatgcagtggacgtctcaaagttccaggaaaaagagaaatctgtgtggctatcaagactctgaaagctggttacactgacaaacaacggagagacttcctgagtgaggccagcatcatgggacaatttgaccaccccaatatcatccacttggaaggcgttgttactaaatgtaaaccagtaatgatcataactgagtacatggagaatggctccttggatgccttcctccggaagaatgatggcagatttacagtaatccagttggtggggatgcttcgtggcatcggctcaggaatgaagtatctgtctgacatgagctatgtgcatcgggatctagctgctcgaaacatactggtcaacagcaacttggtctgcaaagtgtctgacttcggcatgtcccgtgtcctggaagatgaccctgaggcagcttataccacacggggtggcaagatccctatccgatggactgcaccagaggcaattgcctaccgtaaatttacatcggctagtgacgtgtggagctatggcatcgtcatgtgggaagtgatgtcctatggagagagaccttactgggatatgtccaatcaagacgttattaaagccattgaggaagggtatcggttgccacccccaatggactgccccattgctctccatcagctgatgttagactgctggcagaaggaacgcagcgacagacctaaatttggacagattgtcaacatgctggacaaactcatccgcaaccctaacagcctgaagaggacaggcagcgagagctccagacccagcacagccctgctggatcccagctccccggagttctcggcggttgtttctgtcagtgactggctccaagccattaaaatggagcgatacaaggataacttcacagctgctggctataccaccctagaggctgtggtgcatatgaaccaggacgacctggccaggatcgggatcactgccatcacacaccagaacaagatcttgagcagcgttcaagccatgcgcagccaaatgcaacagatgcacggcaggatggtgcccgtctga

SEQ ID NO: 58 - protein, 986 aa, Gallus gallus
MAGVPVGALLPLLVGVCGAVTGSRVYPANEVTLLDSRSVQGELGWIASPLEGGWEEVSIMDEKNTPIRTYQVCNVMEPSQNNWLRTDWIPREGAQRVYIEIKFTLRDCNSLPGVMGTCKETFNLYYYESNNDKERFIRESQFAKIDTIAADESFTQVDIGDRIMKLNTEVRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGYEERNGECQACKIGYYKALSTDVACAKCPPHSYSIWEGSTSCTCDRGFFRAENDAASMPCTRPPSAPQNLISNVNETSVNLEWSAPQNKGGRDDISYNVVCKRCGAGEPSHCRSCGSGVHFSPQQNGLKTTKVSITDLLAHTNYTFEVWAVNGVSKHNPSQDQAVSVTVTTNQAAPSPIALIQAKEITRHSVALAWLEPDRPNGVILEYEVKYYEKDQNERSYRIVKTASRNTDIKGLNPLTSYVFHVRARTAAGYGDFSGPFEFTTNTVPSPIIGDGTNPTVLLVSVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 59 - DNA, 2820 bp, Gallus gallus
cggagagagccagtttgccaagattgacaccattgctgctgatgagagcttcacccaggtggacattggtgacaggatcatgaagctgaatacagaggtgcgggacgtggggcctctcagcaagaaagggttttacttggctttccaggacgtcggtgcctgcattgctttggtgtctgttcgtgtcttctataagaagtgcccactgacagttcgaaacctggcacagtttccagacaccattactggggctgatacatcctctctggtggaggttcgtggctcctgtgtcaacaactcggaagagaaggacgtgccaaaaatgtactgcggggcagatggtgaatggctggtacccattggcaactgtctgtgcaatgctggctatgaagaacgcaatggtgaatgccaagcttgcaaaatcggatactacaaggcgctctcaacagatgttgcatgtgccaaatgcccgcctcacagctactccatctgggaaggctctacctcctgcacctgtgatcggggcttcttccgagcagaaaatgatgctgcatccatgccctgcactcgccctccatccgcaccccagaacctgatttccaacgtcaacgagacgtcagtgaacttggagtggagcgccccacagaacaagggaggacgggacgacatctcctacaacgtggtgtgcaagcgctgcggggcaggggagcccagccactgccggtcctgtggcagtggtgtacatttcagcccccagcagaacgggctgaaaaccacgaaggtttccatcactgacctcctggcacacaccaactacacctttgaggtctgggcagtgaatggagtgtccaagcacaaccccagccaggaccaagctgtgtcggtcactgtgacaactaaccaagcagctccatccccaattgcattgatccaggctaaagagataacgaggcacagcgttgccttggcctggctggaacctgacaggcccaatggagtcatcctggagtacgaagtcaagtactacgaaaaggaccaaaacgagcgcacgtatcgcattgtgaagacagcctccaggaatactgacatcaaaggtttgaaccccctgacttcatatgtatttcatgtgcgggccaggacagcagcaggatacggagacttcagtgggccgtttgagttcacaactaacacagttccttcccccatcattggcgatggtaccaatcccacagtgctgcttgtttcagtggctggcagtgttgttcttgtggtcattctcattgcagcctttgtcatcagcaggaggcgcagcaaatacagtaaagctaagcaagaggcagatgaggagaaacatttgaaccaaggtgtcagaacatatgtggatccttttacatatgaggatccaaatcaagctgtgagggaatttgccaaagaaattgatgcctcctgcataaagattgagaaagttattggtgtgggggaatttggtgaagtatgcagtggacgtctcaaagttccaggaaaaagagaaatctgtgtggctatcaagactctgaaagctggttacactgacaaacaacggagagacttcctgagtgaggccagcatcatgggacaatttgaccaccccaatatcatccacttggaaggcgttgttactaaatgtaaaccagtaatgatcataactgagtacatggagaatggctccttggatgccttcctccggaagaatgatggcagatttacagtaatccagttggtggggatgcttcgtggcatcggctcaggaatgaagtatctgtctgacatgagctatgtgcatcgggatctagctgctcgaaacatactggtcaacagcaacttggtctgcaaagtgtctgactttggcatgtcccgtgtcctggaagatgaccctgaggcagcttataccacacggggtggcaagatccctatccgatggactgcaccagaggcaattgcctaccgtaaatttacatcggctagtgacgtgtggagctatggcatcgtcatgtgggaagtgatgtcctatggagagagaccttactgggatatgtccaatcaagacgttattaaagccattgaggaagggtatcggttgccacccccaatggactgccccattgctctccatcagctgatgttagactgctggcagaaggaacgcagcgacagacctaaatttggacagattgtcaacatgctggacaaactcatccgcaaccctaacagcctgaagaggacaggcagcgagagctccagacccagcacagccctgctggatcccagctccccggagttctcggcggttgtttctgtcagtgactggctccaagccattaaaatggagcgatacaaggataacttcacagctgctggctataccaccctagaggctgtggtgcatatgaaccaggacgacctggccaggatcgggatcactgccatcacacaccagaacaagatcttgagcagcgttcaagccatgcgcagccaaatgcaacagatgcacggcaggatggtgcccgtctgagccagtactgaataaactcaaaactcttgaaattagtttacctcatccatgcactttaattgaagaactgcactttttttacttcgtctcctcgcccgttgaaataaagatctgcagcattgcttgatgtacagattgtggaaaccgagcgtgtgttgggaggggggcctccagaaatgacaagccgtcattttaaaccagacctggaacaaattgtttcttggaacatacttctctgttgatcaacgatatgtaaaatacatgtatcc

SEQ ID NO: 60 - protein, 849 aa, Gallus gallus
GESQFAKIDTIAADESFTQVDIGDRIMKLNTEVRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGYEERNGECQACKIGYYKALSTDVACAKCPPHSYSIWEGSTSCTCDRGFFRAENDAASMPCTRPPSAPQNLISNVNETSVNLEWSAPQNKGGRDDISYNVVCKRCGAGEPSHCRSCGSGVHFSPQQNGLKTTKVSITDLLAHTNYTFEVWAVNGVSKHNPSQDQAVSVTVTTNQAAPSPIALIQAKEITRHSVALAWLEPDRPNGVILEYEVKYYEKDQNERTYRIVKTASRNTDIKGLNPLTSYVFHVRARTAAGYGDFSGPFEFTTNTVPSPIIGDGTNPTVLLVSVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 61 - DNA, 2961 bp, Xenopus laevis
  CDS (1)..(2958)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggaccagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaaccaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactgcatcagctcatgttggactgctggcagaaggatcgtagtgaccgaccaaaatttgggcagatagtcagcatgctggataaactcatcaggaacccaaacagtttgaaaaggactgggctggagaattcaagcagaacaaatacggctctgctggaccccagttcgcctgaatggtcccaggtggcttctgtgcttgattggctgcaggccatcaaaatggaaagatacaaagataacttcacagcagccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcaggatggttcctgtttga

SEQ ID NO: 62 - protein, 986 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCRPCGSGVHYSPQQNGLKTTKVSINDLQAHTNYTFEVWAINGVSKQNPEQDQAVSVTVTTNQAAPSTVTQIQPKEITRHSVSLTWPEPERANGVILEYEVKYYEKDQNERSYRIVKTASRSADIKGLNPLTGYVFHVRARTAAGYGEFSGPFEFTTNTVPSPMIGEGTSPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSSRTNTALLDPSSPEWSQVASVLDWLQAIKMERYKDNFTAAGYTSLEAVVHVNQDDLTRIGISSPSHQNKILSSVQGMRTQLQQMQGRMVPV

SEQ ID NO: 63 - DNA, 2958 bp, Xenopus laevis
  CDS (1)..(2955)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgttcgccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggatcagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaacaaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactacatcagctcatgttggactgctggcagaaggatcgtagtgaccgaccaaaatttgggcagatagtcagcatgctggataaactcatcaggaacccaaacagtttgaaaaggactgggctggagaattcaagaacaaacacggctctgctggaccccagttcgcctgaatggtcccaggtggcttctgtgcttgattggctgcaggcatcaaaatggaaaagatacaaagataacttcacagcggccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcagaatggttcctgtttga

SEQ ID NO: 64 - protein, 985 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCSPCGSGVHYSPQQNGLKTTKVSINDLQAHTNYTFEVWAINGVSKQNPEQDQAVSVTVTTNQAAPSTVTQIQPKEITRHSVSLTWPEPERANGVILEYEVKYYEKDQNERSYRIVKTASRSADIKGLNPLTGYVFHVRARTAAGYGEFSGPFEFTTNTVPSPMIGEGTSPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSRTNTALLDPSSPEWSQVASVLDWLQASKWKRYKDNFTAAGYTSLEAVVHVNQDDLTRIGISSPSHQNKILSSVQGMRTQLQQMQGRMVPV

SEQ ID NO: 65 - DNA, 2961 bp, Xenopus laevis
  CDS (1)..(2958)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaaaactaccaaagtgtccatcactgacctgcaagcccataccaactacacatttgaggtctggtccattaatggtgtctccaagcagaaccctggacaagatcaggccgtgtcagttactgtgaccaccaaccaagctgctccatcaactgtaacccagatacagccaaaagacatcaccaggcacagcgtgtctttgacttggccagagcctgagcgacccaatggcgtcatactggaatacgaagtcaagtattatgaaaaggaccagaatgagcgtacgtaccgcattgtgaagacaacctcgcggagtgcagacatcaaaggtctcaatccccttacggcctatgtgttccatgtccgtgctcgaactgctgcaggatatggggagtttagtggaccctttgagttcaccactaatacagtgccatcccctatgattggagaaggagccagccccactgtgcttttggtgtccgttgctggaagtattgtccttgtggttattctcattgctgcatttgtcatcagcagaaggcggagtaaatacagtaaagccaagcaagaagcagatgaggaaaaacatttaaaccaaggagtgaagacgtatgtggacccatttacttatgaagatcctaaccaggcagtccgtgaatttgcaaaggaaatcgatgcctcttgtattaagatcgaaaaagtcattggagtaggtgaatttggtgaagtttgtagtgggcgtctgaaggtccccggaaagagagagatttatgttgcaataaagactttgaaagctggttacaccgataagcagaggagagactttctaagtgaggccagcatcatgggtcagtttgaccatcccaacatcatccaccttgaaggtgttgtcaccaaatgcaagccagtgatgataattaccgagtacatggagaacggatccttggatgcattccttcgaaagaatgacgggcggtttacggtgatacagcttgtgggaatactgcgtggcattgggtctggaatgaaatacctctcagatatgagttatgtacatcgggacctagctgctcgtaatatccttgtgaacagcaatctagtctgtaaggtctctgacttcggcatgtctcgagtgctggaagatgaccctgaagcagcctacacaaccaggggtggcaagatcccgatccgatggacagcaccagaagctattgcgtacaggaaattcacctctgccagcgatgtctggagctatggcattgtcatgtgggaagtcatgtcttatggagagaggccctactgggatatgtccaatcaagacgttattaaagcaatcgaggaaggatacaggctgcccccaccaatggactgccctatcgcactgcatcagctcatgttggactgctggcagaaggagcgtagtgaccgaccaaagtttgggcaaatagtcagcatgctggataagctcatcaggaacccaaacagtttgaaaaggactggtctggacaattcaagcagaacaaatacgactctgctggaccccagctcgcctgaatggtcccaggtggcttctgtgcttgattggctgcaggccatcaaaatggaaagatacaaagataacttcacagcggccggatacaccagcttggaagcagtcgtgcatgtaaatcaagatgacctgaccaggattggcattagttccccttcacaccagaacaagattctgagcagtgttcagggaatgaggacccagatgcagcaaattcaaggcaggatggttcctgtttga

SEQ ID NO: 66 - protein, 986 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCRPCGSGVHYSPQQNGLKTTKVSITDLQAHTNYTFEVWSINGVSKQNPGQDQAVSVTVTTNQAAPSTVTQIQPKDITRHSVSLTWPEPERPNGVILEYEVKYYEKDQNERTYRIVKTTSRSADIKGLNPLTAYVFHVRARTAAGYGEFSGPFEFTTNTVPSPMIGEGASPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGILRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVSMLDKLIRNPNSLKRTGLDNSSRTNTTLLDPSSPEWSQVASVLDWLQAIKMERYKDNFTAAGYTSLEAVVHVNQDDLTRIGISSPSHQNKILSSVQGMRTQMQQIQGRMVPV

SEQ ID NO: 67 - DNA, 3278 bp, Xenopus laevis
  CDS (73)..(3033)
aagggaagtggagcgggcacggtgtgtataggcatctcttaatccacctccggccccttagctgcagccaccatggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggaccagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaaccaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactgcatcagctcatgttggactgctggcagaaggatcgtagtgaccgaccaaaatttgggcagatagtcagcatgctggataaactcatcaggaacccaaacagtttgaaaaggactgggctggagaattcaagcagaacaaatacggctctgctggaccccagttcgcctgaatggtcccaggtggcttctgtgcttgattggctgcaggccatcaaaatggaaagatacaaagataacttcacagcagccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcaggatggttcctgtttgaagctgcaggacgtcaaagggggggcaatttctcagaactcttgaaagaaaaattagtttacctcatccatgcactttaattgaagaactgcactttttttacattatcctcaccccgtgggacaaggactctgcagaagtatttggggataagctgaaactcatttaacatggagcatttgtgcaacacagttttggaagatcgtgcgtcagcaacttaaggatgtagacaaaaaaaaaaaaaaa

SEQ ID NO: 68 - protein, 986 aa, Xenopus laevis; identical to SEQ ID NO: 62

SEQ ID NO: 69 - DNA, 2961 bp, Danio rerio
  CDS (1)..(2958)
  misc_feature (1269)..(1269): The 'w' at location 1269 stands for a or t.
atggctgcgcttgtgttcacagcgacttttgcgctaataatctggataccgactttcgtattaaccgcacgggtctaccctcctaatgaagtgacactgctggactcgagaactgtgcaaggagaattgaaatgggttgcaagtccgacggaaggagggtgggaagaggtgagcatcatggatgagaagaatacgccaatcaggacgtaccaggtgtgcaacgtaatggaacccagccagaacaactggctccgaacggactggatcccccgtggcggagctcagcgggtctacatcgagatcaaattcaccctgcgtgactgcaacagcctgccaggagtcatgggaacctgcaaggagacctttaatctttactattatgagtccaacaatgacaaagagcgatacatccgagaaaaccagttcaccaaaatcgacaccattgcggctgatgaaagcttcacgcaggtggacataggagaccgcatcatgaagctgaacacggaggtgagggatgtggggattttgacaaggaagggcttctacctggccttccaggacgttggggcttgcattgccttggtatcagtacggatcttctacaagaaatgcccgcttactgtacgcaacctggcccaatttccagacaccaccaccggggcagacacctcatcgctagtggaggtacgcggatcctgtgtggacaattcggaggaacgtgaggtccctaaaatgtactgcggagcagatggagaatggctggtgcctattggaaactgtttgtgtaaccctggctatgaagaacatgaagggacatgtcaagcctgtaagatcggtaactacagagctctagccacagacggcagctgctctaagtgtcccctgcacagctactctgtgagagagggatctacttcctgtgcctgtgataaaggcttcttcaggtctgagacggaccctgcatctatgccctgcacacagcccccatctgctcctcagcacctcatttccaatgtgaacgagacttcggtaaatctggagtggacggctccagcatcctctggtggcagacaggaccttgcctataacgttatatgcaagcggtgcagctcggacggtcaacgctgtcagccctgcggcaatggcatccatttttcccctcagcagctgggtctacgcactacccgggtgtccataaatgacctgcaggctcacaccaactacaccttcgagatctgggcagtcaacggggtctccaaacagagtccwggacccgaacaagcagtctctgtgactgttaccaccaaccaagcggctccctctccagttaccaccatccaggccaaggacatcacaagacatgctgtgtctttggcatggcaacaacccgagagacccaatggagtcattcttgagtacgaggtcaaatactatgagaaggatcaaaacgagcgcagttatcgcataatgaagacttcgtcccgaagcgctgagatcaaaggcctgagcccactcacctcctacgtgtttcatgtgcgtgcccgcaccgctgctggctacggagaattcagtgccccttttgagttcatgaccaactcagttccttctcccatcatcggggacggagctaactccaccgtgctcttggtgtctgtgatcggcagtgtgattttgttgctcatcttcatcggcgtcttcatcatcagccgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcactggatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacccattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgccgcacaccaggataagatcctcaacagcgcgcagggaatgttgtcccagatgcagcaaatgcaggacaggatggttcctgtctga

SEQ ID NO: 70 - protein, 986 aa, Danio rerio
  misc_feature (423)..(423): The 'Xaa' at location 423 stands for Pro.
MAALVFTATFALIIWIPTFVLTARVYPPNEVTLLDSRTVQGELKWVASPTEGGWEEVSIMDEKNTPIRTYQVCNVMEPSQNNWLRTDWIPRGGAQRVYIEIKFTLRDCNSLPGVMGTCKETFNLYYYESNNDKERYIRENQFTKIDTIAADESFTQVDIGDRIMKLNTEVRDVGILTRKGFYLAFQDVGACIALVSVRIFYKKCPLTVRNLAQFPDTTTGADTSSLVEVRGSCVDNSEEREVPKMYCGADGEWLVPIGNCLCNPGYEEHEGTCQACKIGNYRALATDGSCSKCPLHSYSVREGSTSCACDKGFFRSETDPASMPCTQPPSAPQHLISNVNETSVNLEWTAPASSGGRQDLAYNVICKRCSSDGQRCQPCGNGIHFSPQQLGLRTTRVSINDLQAHTNYTFEIWAVNGVSKQSXGPEQAVSVTVTTNQAAPSPVTTIQAKDITRHAVSLAWQQPERPNGVILEYEVKYYEKDQNERSYRIMKTSSRSAEIKGLSPLTSYVFHVRARTAAGYGEFSAPFEFMTNSVPSPIIGDGANSTVLLVSVIGSVILLLIFIGVFIISRRRSKYSKAKQDSDEERHLHPGVRIYVDPFTYEDPNQAVREFAKEIDASCIKIEKVIGIGEFGEVCSGRLKMPGKREICVAIKTLKAGYTDKQRRDFLSEASIMGQFDHPNIIRLEGVVTKCKPVMIITEYMENGSLDAFLRKNDGRFTVIQLVGILRGIASGMKYLSDMSYVHRDLAARNILVNSNLVCKVSDFGMSRVLEEDPDAAYTTRGGKIPIRWTAPEAITYRKFTSASDVWSYGIVMWEVMSYGERPYWDMSNQDVIKAIEEGYRLPPPMDCPVSLHQLMLDCWQKERAERPKFSQIVNMLDKLIRNPNSLKRTGGEIARPNTTLLEPSSPEFTSTLGSVADWLQAINMERYRDNFTAAGYTTPEAVVHMTQEDMTRIGISTAAHQDKILNSAQGMLSQMQQMQDRMVPV

SEQ ID NO: 71 - DNA, 2214 bp, Danio rerio
  CDS (1)..(2211)
atggacaatgagagcatgattgttctcctattgtccaagccagtggtcagaggcttcatggagagagggaggaaagcctgtaagatcggtaactacagagctctagccacagacggcagctgctctaagtgtcccctgcacagctactctgtgagagagggatctacttcctgtgcctgtgataaaggcttcttcaggtctgagacggaccctgcatctatgccctgcacacagcccccatctgctcctcagcacctcatttccaatgtgaacgagacttcggtaaatctggagtggacggctccagcatcctctggtggcagacaggaccttgcctataacgttatatgcaagcggtgcagctcggacggtcaacgctgtcagccctgcggcaatggcatccatttttcccctcagcagctgggtctacgcactacccgggtgtccataaatgacctgcaggctcacaccaactacaccttcgagatctgggcagtcaacggggtgtccaaacagagtcctggacccgaacaagcagtctctgtgactgttaccaccaaccaagcggctccctctccagttaccaccatccaggccaaggacatcacaagacatgctgtgtctttggcatggcaacagcccgagagacccaatggagtcattcttgagtacgaggtcaaatactatgagaaggatcaaaacgagcgcagttatcgcataatgaagacttcgtcccgaagcgctgagatcaaaggcctgagcccactcacctcctacgtgtttcatgtgcgtgcccgcaccgctgctggctacggagaattcagtgccccttttgagttcatgaccaactcagttccttctcccatcatcggggacggagctaactccaccgtgctcttggtgtctgtgatcggcagtgtgattttgttgctcatcttcatcggcgtcttcatcatcagccgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcacttgatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacctattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgctgcacaccaggataagatcctcaacagcgcgcagggaatgttgtcccagatgcagcaaatgcaggacaggatggttcctgtctga

SEQ ID NO: 72 - protein, 737 aa, Danio rerio
MDNESMIVLLLSKPVVRGFMERGRKACKIGNYRALATDGSCSKCPLHSYSVREGSTSCACDKGFFRSETDPASMPCTQPPSAPQHLISNVNETSVNLEWTAPASSGGRQDLAYNVICKRCSSDGQRCQPCGNGIHFSPQQLGLRTTRVSINDLQAHTNYTFEIWAVNGVSKQSPGPEQAVSVTVTTNQAAPSPVTTIQAKDITRHAVSLAWQQPERPNGVILEYEVKYYEKDQNERSYRIMKTSSRSAEIKGLSPLTSYVFHVRARTAAGYGEFSAPFEFMTNSVPSPIIGDGANSTVLLVSVIGSVILLLIFIGVFIISRRRSKYSKAKQDSDEERHLHPGVRIYVDPFTYEDPNQAVREFAKEIDASCIKIEKVIGIGEFGEVCSGRLKMPGKREICVAIKTLKAGYTDKQRRDFLSEASIMGQFDHPNIIRLEGVVTKCKPVMIITEYMENGSLDAFLRKNDGRFTVIQLVGILRGIASGMKYLSDMSYVHRDLAARNILVNSNLVCKVSDFGMSRVLEEDPDAAYTTRGGKIPIRWTAPEAITYRKFTSASDVWSYGIVMWEVMSYGERPYWDMSNQDVIKAIEEGYRLPPPMDCPVSLHQLMLDCWQKERAERPKFSQIVNMLDKLIRNPNSLKRTGGEIARPNTTLLEPSSPEFTSTLGSVADWLQAINMERYRDNFTAAGYTTPEAVVHMTQEDMTRIGISTAAHQDKILNSAQGMLSQMQQMQDRMVPV

SEQ ID NO: 73 - DNA, 3126 bp, Equus caballus
  CDS (57)..(3017)
aagcatttattccactgggatagaagcggcaggagcagcgttggcaccggcgaatcatggctgggattttctatttcctcctcttttcgtttctctttgggatttgcgacgctgtcaccggttccagggtgtaccccgcgaatgaagttaccttgttggattccagatccgttcagggagaacttgggtggattgcaagccctctggaaggagggtgggaggaagtgagtattatggatgaaaaaaatacgccaatccgaacctaccaagtgtgcaacgtgatggaacccagccagaataactggctacgaactgactggatcacccgagaaggggctcagagggtgtacattgagattaagttcaccttgagggactgcaatagtcttccgggcgtcatggggacctgcaaggagacgtttaacctgtattattatgaatcagacaacgacaaagagcgtttcatccgagagagccagtttgccaagattgacaccatcgctgccgacgagagcttcacccaagtggacattggcgacagaatcatgaagctgaacacggagatccgggatgtagggccgctgagcaaaaaggggttttatctggcttttcaggatgtgggggcctgcattgccctggtatcggtccgcgttttctataagaagtgcccgctcacggttcgcaatctggcccagtttccagacaccatcacaggggccgatacgtcttccctggtggaagtccgaggctcctgtgtcaacaactcagaagagaaggatgtgccaaaaatgtactgtggggcagatggtgaatggctggtacccattggcaactgcctgtgcaatgctgggcatgaagagcggaatggagaatgccaagcctgcaaaattggatattacaaggctctctccacggatgccacctgtgccaagtgcccaccccacagctactccgtctgggaaggagccacatcgtgcacctgtgaccgcggctttttcagagccgacaatgatgctgcctctatgccctgcacccgcccaccgtctgctcccctcaacttgatttcaaatgtcaatgagacttcagtgaacttggaatggagcagtcctcagaacacgggtggccgccaggacatctcctacaacgtggtatgcaagaaatgtggagccggcgattccagcaagtgccggccctgcggaagtggagtccactataccccacagcagaatggcctgaagaccaccaaagtctccatcaccgacctcctggctcataccaattacacatttgaaatctgggcagtgaatggagtgtccaagtataaccccagcccggaccaatcagtgtccgtcaccgtgacaactaaccaagcagcaccatcatccattgctttggtgcaggctaaagaagttacaagatacagtgttgctctggcttggctggaaccagatcggcccaatggggtgatcctggagtatgaagtcaagtattatgagaaggatcagaatgagcgaagctatcggatcgtgcggacggctgccaggaacacggatatcaagggcctgaaccctctgacttcctacgtctttcatgtccgggccaggacagcagctggctatggagacttcagcgagcccctggaggtcacaaccaacacagtgccttcccggatcatcggagatggggccaactccactgtccttctggtctccgtctcaggcagtgtggtactggtggtcattctcatcgcagcctttgtcatcagtaggagacggagtaaatacagtaaagcaaaacaagaagcagatgaagagaaacatttgaatcaaggtgttagaacttatgtggatccttttacatacgaagatcccaaccaagcagttcgagaatttgccaaagaaatcgacgcatcttgcattaagattgaaaaagtcataggagttggtgaatttggcgaagtatgcagtgggcgtctcaaagtgcctggcaagagagagatctgtgtggccatcaagacactgaaagctggttatacagacaaacagaggagagacttcctgagcgaggccagcatcatgggacagtttgaccacccgaatataattcacctggaaggcgtcgtcaccaaatgtaaaccggtaatgatcataacagagtacatggagaatggctccttggatgcattcctcaggaagaatgacggcagatttacagtcattcagctggtgggcatgcttcgtggcattgggtctgggatgaagtatttatctgatatgagctatgtgcatcgagatctggctgcacggaacattctggtgaatagcaacttggtctgcaaagtgtctgattttggcatgtcgcgagtgcttgaggatgacccggaagcagcttataccaccaggggtggcaagattcctatccggtggactgcgccagaagcaattgcctatcgtaaattcacatcagcaagtgatgtatggagctatggaatcgttatgtgggaagtgatgtcgtatggagagagaccttattgggatatgtccaatcaagatgtgattaaagccattgaggaaggctatcgactaccccctccaatggactgccccattgccctccaccagctgatgctagactgctggcagaaggagagaagtgacaggcccaaatttgggcagattgtcaacatgttggacaaactcatccgcaaccccaacagcttgaagaggacggggactgagagctccagacctaacactgccttgttggatccgagctccccggaattctccgccgtagtatcggtgggcgattggctccaggccattaaaatggaccggtataaggataacttcacggctgctggttataccacactagaggctgtagtgcacgtgaaccaggatgacctggcaagaattgggatcaccgctgtcacacaccagaataagattttgagcagtgtccaggcgatgagaacccaaatgcagcagatacacggcagaatggttcctgtctgagccggtactgaataaactcaaaactcttgaaattagtttacctcatccatgcactttaattgaaggactgcacttttttttacttcgtcttcgccctccgaaattaaag

SEQ ID NO: 74 - protein, 986 aa, Equus caballus
MAGIFYFLLFSFLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDSSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDDLARIGITAVTHQNKILSSVQAMRTQMQQIHGRMVPV

SEQ ID NO: 75 - DNA, 2961 bp, Sus scrofa
  CDS (1)..(2958)
atggctgggattttctatttcgtcctcttttcgtttctctttgggatttgcgacgctgtcaccggttccagggtatatcccgcaaatgaagttaccttattggattccagatctgttcagggagaacttgggtggatagcaagccctctggaaggagggtgggaggaagtgagtattatggatgaaaaaaatacaccaatccggacctaccaagtgtgcaacgtgatggaacccagccagaataactggctgcgaactgattggatcacccgagaaggggctcagagggtgtacattgagatcaagttcaccttgagggactgcaacagtcttccgggtgtcatgggcacgtgcaaggagacgtttaacctgtactactatgaatcagacaacgacaaagagcgttttatccgagagagccagtttgccaaaattgacaccatcgccgccgacgagagcttcacccaggtggacattggcgaccgaatcatgaagctgaacacagagatccgggatgtggggccactgagcaaaaaggggttctatctggcgtttcaggatgtgggagcctgcatcgccttggtatccgtccgcgtcttctacaagaagtgtccgctcacagttcgcaatctcgcccagtttccagacaccgtcacaggggcagatacgtcttctctggtggaagttcgaggctcctgtgtcaacaactcagaaaagaaggatgtgccaaaaatgtactgtggggcagatggtgaatggctggtacccattggcaactgtctatgcaatgctgggcatgaagagcggaatggagaatgccaagcttgcaaaattggatattacaaggccctctccacagatgccacctgtgccaagtgcccacctcacagctactctgtctgggaaggagccacatcctgcacctgtgaccgaggcttcttccgagccgacaatgatgctgcctctatgccctgcacccgcccaccatctgctcctctaaacttgatctcaaatgtcaatgagacatccgtgaacttggaatggagcagtcctcagaacacgggtggccgccaggacatttcctacaacgtcgtgtgcaagaagtgtggagcgggtgactctagcaagtgtcgaccttgtggaagtggggtccactacaccccacagcagaacggcctgaagaccaccaaggtctccatcactgacctcctggctcataccaactacacgtttgaaatctgggcagtgaatggtgtgtccaagtataaccctagcccggaccagtctgtgtctgtcactgtgaccaccaaccaagcagcaccctcctccattgctttggtccaggctaaagaagttacaagatacagcgtggccctggcttggctggaacctgatcggcccaatggtgtgatcttggaatatgaagtcaaatattatgagaaggatcagaacgaacgaagctatcgaatcgtcaggacagctgccaggaacacggatatcaaaggcctgaaccctctgacgtcctatgttttccatgtccgagcgaggacagcagctggctatggagacttcagcgagcccctggaggtcacaactaacacagtgccttcccggatcattggagatggggccaactccaccgtcctgctggtctccgtctcaggcagcgttgtgctggtggtcattctcatcgccgcctttgtcatcagcaggagacgaagtaaatacagtaaagcaaagcaagaagcagatgaagagaaacatttgaatcaaggtgttagaacttacgtggacccctttacctacgaagatcccaatcaagcagttcgagaatttgccaaagaaatcgacgcatcctgcattaagatcgaaaaagtcatcggagttggtgaatttggtgaagtatgcagtgggcgtctcaaagtgcctggcaaaagagaaatttatgtggctatcaagacgctgaaagctggttatacagacaaacagaggagggacttcctgagtgaggccagcatcatgggacagttcgaccaccccaatatcattcacttggaaggcgtcgtcaccaaatgtaaaccagtaatgatcataacagagtacatggagaacggctccttggacgcattcctcaggaagaatgatggcaggtttacggtcattcagctggtgggcatgcttcgtggcattgggtccgggatgaagtatttatcggatatgagctacgtgcatcgagacctggctgcacggaacattctagtcaatagcaacttggtctgcaaagtgtctgatttcggcatgtcccgggtgctggaggatgatccagaagccgcttatactaccaggggtggcaagattcctatccggtggactgcgccagaagcaattgcctatcgtaaattcacatcagcaagtgatgtatggagctacgggatcgttatgtgggaagtgatgtcgtatggagagagaccctactgggacatgtccaatcaagatgtgattaaagccatcgaggaaggctatcggctgccccctccaatggactgccccattgcactccaccagctgatgctggactgctggcagaaggagagaagcgacaggccgaaatttgggcagattgtcaacatgttggacaaactcatccgcaaccccaacagcttgaagaggacggggaccgagagctccagacctaacactgccttgttggatccaagctcccctgagttctctgccgtggtatcggtgggtgattggctccaggccattaaaatggaccgatataaggataacttcactgctgctggttataccacactagaggctgtagtgcacatgaaccaggatgacctggccagaattggcatcacggctgtcacacaccagaataagattttgaacagcatccaggcgatgagaacccaaatgcaacagatacacggcagaatggttcccgtctga

SEQ ID NO: 76 - protein, 986 aa, Sus scrofa
MAGIFYFVLFSFLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRESQFAKIDTIAADESFTQVDIGDRIMKLNTEIRDVGPLSKKGFYLAFQDVGACIALVSVRVFYKKCPLTVRNLAQFPDTVTGADTSSLVEVRGSCVNNSEKKDVPKMYCGADGEWLVPIGNCLCNAGHEERNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDSSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQDDLARIGITAVTHQNKILNSIQAMRTQMQQIHGRMVPV

SEQ ID NO: 77 - DNA, 2961 bp, Ornithorhynchus anatinus
  CDS (1)..(2958)
atggctgggattttctatttcatcgtcttttcgcttctctttgggatttgcaacggggtgaccggttctcggatatatcccgcgaatgaagttaccttgctggattccagatcagttcagggagagcttggatggatagcaagtcctttagaaggagggtgggaggaagtgagcattatggatgagaaaaatactccaatacgcacctaccaagtctgcaatgtgatggagcccagccagaacaattggctacgaactgattggattccccgcgaaggggctcagagggtgtatatcgagattaaattcacactgagagactgcaacagcctgccaggtgtcatgggaacctgtaaggagaccttcaatctttactactacgaatcaaacaacgataaagaacgcttcatcagagaaagtcagtttgctaaaatcgacaccatcgctgccgatgaaagcttcacccaagtggacattggtgaccggatcatgaaattaaacaccgaaatccgtgacgtggggccattgagcaagaaagggttttacctggcttttcaggatgttggggcctgcattgccctggtatccgtgcgggtgttctacaagaagtgcccactgacagttcgcaacctggctcagtttcccgacaccgtcaccggggctgacacatcctccctagtggaggtccgaggctcctgtgttaataactcagaagagaaggatgttccaaagatgtattgtggggcagatggtgaatggttggtgcctattggcaactgtgtgtgcaatgctgggcacgaagagcgcaatggagaatgtcaagcctgtaaaattggatactacaaggccctgtccaccgacgcttcctgtgccaaatgtcctcctcatagctattccgtctgggaaggagccacctcttgcacctgtgacagaggatttttccgagcagacaacgatgccgcctctatgccctgcactcgtcctccctcggctcccctgaacctgatttccaaagtcaatgagacatcggtgaatttggagtggagcagccctcagaacacgggtggtcgacaggatatttcctataatgtggtatgcaagaaatgtggcaccggtgatctcagccgatgtcggtcctgtgggagtggagtacactacaccccccaacagaatggtctgaagagcaccaaagtctctatcactgacctcttggcacacacgaactacacctttgaaatctgggccgtgaacggagtatccaaacacaaccccagccatgaccaatcagtctctgtcacagttacgaccaatcaagcagctccttcttcaattgctttgatccaggctaaagaaataacaagatacagtgttgcgttagcttggttagagcctgataggccaaatggagtcatcttggagtatgaagtcaaatattatgagaaggatcagaatgaacgcagctaccgaattgttaggacagcatccagaaacactgatatcaaaggcctgaatcctttgacttcctatgtatttcatgtgcgggcccggaccgcagccggatatggagatttcagcgaaccgtttgaattcacaaccaacacagtcccttcacgaatcattggagatggtaccaattccacagtgcttctggcttcagttgcaggcagtgttgttctggtagtcattctcattgctgcatttgtcatcagcagaagacgcagtaaatacagcaaggctaagcaagaagcggatgaagagaaacatttgaatcaaggggtgagaacctatgtggatccttttacctatgaagatcctaaccaagctgtccgagaatttgccaaggaaatagatgcctcttgcatcaagattgaaaaagtcattggagttggtgagtttggcgaagtatgcagtgggcgtctcaaagtgcctggcaagcgggagatctgtgtggcaattaagactctcaaagcagggtatacggacaaacaaaggagggacttcttgagtgaggccagcatcatggggcagtttgaccaccctaatatcatccacttagaaggcgtcgtcaccaaatgtaagccagtaatgatcataaccgagtacatggaaaatggatccttggatgcattcctgaggaagaatgatggccgatttacagtcatacagttggtggggatgcttcgtggcattggctcgggaatgaagtatctgtccgatatgagttacgtgcatagggatctagctgcccgaaacatcctggtaaatagtaacctggtctgcaaagtgtccgattttggcatgtctcgagtacttgaggatgatcccgaagctgcttatacgacaaggggcggcaagattcccatccggtggactgcaccagaagcgatcgcatatcgtaaattcacatcagcaagtgatgtgtggagctatggaattgtaatgtgggaagtgatgtcatatggggagagaccgtactgggacatgtccaatcaagacgtaattaaagccatcgaagaaggatatagactacctccccctatggactgtcccattgcactccatcagctgatgcttgactgttggcagaaggagagaagtgacaggcctaaatttggacagattgtcaatatgttggacaaactcatccgcaaccccaacagcttgaagaggacgggcacggagagctccagacctaatactgccttgttggacccaagttctcctgaattctctgctgtggtgtcagtgactgactggctccaggccattaaaatggagcggtacaaggataacttcacagctgctggctacaccaccctagaggctgtggtgcacatgaaccaggacgacctgacaagaattggcatcaccgccatcacacatcagaacaagattttgggcagcgtccagtcaatgcggacccaaatgcaacagatgcacggcagaatggttcccgtctga

SEQ ID NO: 78 - protein, 986 aa, Ornithorhynchus anatinus
MAGIFYFIVFSLLFGICNGVTGSRIYPANEVTLLDSRSVQGELGWIASPLEGGWEEVSIMDEKNTPIRTYQVCNVMEPSQNNWLRTDWIPREGAQRVYIEIKFTLRDCNSLPGVMGTCKETFNLYYYESNNDKERFIRESQFAKIDTIAADESFTQVDIGDRIMKLNTEIRDVGPLSKKGFYLAFQDVGACIALVSVRVFYKKCPLTVRNLAQFPDTVTGADTSSLVEVRGSCVNNSEEKDVPKMYCGADGEWLVPIGNCVCNAGHEERNGECQACKIGYYKALSTDASCAKCPPHSYSVWEGATSCTCDRGFFRADNDAASMPCTRPPSAPLNLISKVNETSVNLEWSSPQNTGGRQDISYNVVCKKCGTGDLSRCRSCGSGVHYTPQQNGLKSTKVSITDLLAHTNYTFEIWAVNGVSKHNPSHDQSVSVTVTTNQAAPSSIALIQAKEITRYSVALAWLEPDRPNGVILEYEVKYYEKDQNERSYRIVRTASRNTDIKGLNPLTSYVFHVRARTAAGYGDFSEPFEFTTNTVPSRIIGDGTNSTVLLASVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVTDWLQAIKMERYKDNFTAAGYTTLEAVVHMNQDDLTRIGITAITHQNKILGSVQSMRTQMQQMHGRMVPV

SEQ ID NO: 79 - DNA, 3402 bp, Homo sapiens
  CDS (315)..(2147)
atgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaaaaaaaaaaaaaaaaaaaaaaaaa

SEQ ID NO: 80 - protein, 610 aa, Homo sapiens
MQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 81 - DNA, 2387 bp, Homo sapiens
  CDS (20)..(2143)
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaaaaaaaaaaaaaaaaaaaaaaaaaaaaaaaaaaaaaaaaa

SEQ ID NO: 82 - protein, 707 aa, Homo sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 83 - DNA, 1404 bp, Mus musculus
  CDS (1)..(1401)
atgacagagatacctgcacctttgtcctacttccagaatgcccagatgtctgaggacagccactccagcagcgccatccggagccagaatgacagccaagaacggcagcagcagcatgacaggcagagacttgacaaccctgagccaatatctaatgggcggccccagagtaactcaagacaggtggtggaacaagatgaggaggaagacgaagagctgacattgaaatatggagccaagcatgtcatcatgctctttgtccccgtgaccctctgcatggtcgtcgtcgtggccaccatcaaatcagtcagcttctatacccggaaggacggtcagctaatctacaccccattcacagaagacactgagactgtaggccaaagagccctgcactcgatcctgaatgcggccatcatgatcagtgtcattgtcattatgaccatcctcctggtggtcctgtataaatacaggtgctacaaggtcatccacgcctggcttattatttcatctctgttgttgctgttctttttttcgttcatttacttaggggaagtatttaagacctacaatgtcgccgtggactacgttacagtagcactcctaatctggaattttggtgtggtcgggatgattgccatccactggaaaggcccccttcgactgcagcaggcgtatctcattatgatcagtgccctcatggccctggtatttatcaagtacctccccgaatggaccgcatggctcatcttggctgtgatttcagtatatgatttggtggctgttttatgtcccaaaggcccacttcgtatgctggttgaaacagctcaggaaagaaatgagactctctttccagctcttatctattcctcaacaatggtgtggttggtgaatatggctgaaggagacccagaagcccaaaggagggtacccaagaaccccaagtataacacacaaagagcggagagagagacacaggacagtggttctgggaacgatgatggtggcttcagtgaggagtgggaggcccaaagagacagtcacctggggcctcatcgctccactcccgagtcaagagctgctgtccaggaactttctgggagcattctaacgagtgaagacccggaggaaagaggagtaaaacttggactgggagatttcattttctacagtgttctggttggtaaggcctcagcaaccgccagtggagactggaacacaaccatagcctgctttgtagccatactgatcggcctgtgccttacattactcctgctcgccattttcaagaaagcgttgccagccctccccatctccatcaccttcgggctcgtgttctacttcgccacggattaccttgtgcagcccttcatggaccaacttgcattccatcagttttatatctag

SEQ ID NO: 84 - protein, 467 aa, Mus musculus
MTEIPAPLSYFQNAQMSEDSHSSSAIRSQNDSQERQQQHDRQRLDNPEPISNGRPQSNSRQVVEQDEEEDEELTLKYGAKHVIMLFVPVTLCMVVVVATIKSVSFYTRKDGQLIYTPFTEDTETVGQRALHSILNAAIMISVIVIMTILLVVLYKYRCYKVIHAWLIISSLLLLFFFSFIYLGEVFKTYNVAVDYVTVALLIWNFGVVGMIAIHWKGPLRLQQAYLIMISALMALVFIKYLPEWTAWLILAVISVYDLVAVLCPKGPLRMLVETAQERNETLFPALIYSSTMVWLVNMAEGDPEAQRRVPKNPKYNTQRAERETQDSGSGNDDGGFSEEWEAQRDSHLGPHRSTPESRAAVQELSGSILTSEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 85 - DNA, 1407 bp, Rattus norvegicus
  CDS (1)..(1404)
atgacagagatacctgcacctttgtcctacttccagaatgcacagatgtctgaggacagccactccagcagcgtccgtagccagaatgacaatcaagaacggcagcagcatcatgacagacagagacttgacaaccctgagtcgatatctaatggccgaccccagagtaactttaccaggcaggtgatagagcaagatgaggaggaagacgaagagctgacattgaaatatggagccaagcacgtcatcatgctctttgttcctgtgaccctctgcatggtcgttgtggtggccactatcaagtcagtcagcttctacacccggaaggatgggcagctaatctataccccattcacagaagacaccgagactgtaggccagagagccctgcactcgatcttgaatgccgccatcatgatcagtgtcatcgtcgttatgaccatcctcctggtggtcctgtataagtacaggtgctacaaggtcatccatgcctggcttattgtttcatctctgttgttgctgttctttttttcattcatttacttaggggaagtattcaagacctacaatgtcgccgtggactatattacggttgcactcctgatctggaattttggtgtggtcgggatgattgccattcactggaaaggcccactccgactgcagcaggcgtatctcattatgatcagtgccctcatgtccctggtatttatcaagtacctccctgaatggaccgcatggctcatcttggctgtgatttcagtatatgatttggtggctgttctgtgccccaaaggtccacttcgtatgctggtcgaaacagctcaggaaagaaatgagactctctttccagctcttatctattcctcaaccatggtgtggttggtgaatatggctgaaggagacccagaagcccaaaggagggtacccaaaaaccccaagtatagcacacaaggaacagagagggaagagacacaggacactggcactgggagcgatgatggtggcttcagtgaggagtgggaggcccaaagagacagtcacctggggcctcatcgctccactcctgagtcaagagctgctgtccaggaactttctgggagcatcctcactagtgaagacccggaggaaagaggagtaaggcttgggctgggagatttcattttctacagtgttctggttggtaaggcctcagcgaccgccagtggggactggaacacaaccatagcctgctttgtagccatattgatcggcctgtgccttacgttactcctgctcgccattttcaagaaagcgttgccggcccttcccatctccatcaccttcgggctcattttctactttgccacggattatctcgtgcagcccttcatggaccaacttgcattccatcaattttatatctag

SEQ ID NO: 86 - protein, 468 aa, Rattus norvegicus
MTEIPAPLSYFQNAQMSEDSHSSSVRSQNDNQERQQHHDRQRLDNPESISNGRPQSNFTRQVIEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIVSSLLLLFFFSFIYLGEVFKTYNVAVDYITVALLIWNFGVVGMIAIHWKGPLRLQQAYLIMISALMSLVFIKYLPEWTAWLILAVISVYDLVAVLCPKGPLRMLVETAQERNETLFPALIYSSTMVWLVNMAEGDPEAQRRVPKNPKYSTQGTEREETQDTGTGSDDGGFSEEWEAQRDSHLGPHRSTPESRAAVQELSGSILTSEDPEERGVRLGLGDFIFYSVLVGKASATASGDWNTTIACFVAILIGLCLTLLLLAIFKKALPALPISITFGLIFYFATDYLVQPFMDQLAFHQFYI

SEQ ID NO: 87 - DNA, 1404 bp, Homo sapiens
  CDS (1)..(1401)
atgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctag

SEQ ID NO: 88 - protein, 467 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 89 - DNA, 1347 bp, Mus musculus
  CDS (1)..(1344)
atgctcgcattcatggcctctgacagcgaggaagaggtgtgtgatgagcggacgtccttgatgtcagccgagagccccacatctcgctcctgccaggaaggcaggccaggcccggaggatggagagagcactgcccagtggaggactcaggagagcgaagaagactgtgaagaggacccggaccgctacgcatgcagtggggctcctgggcgaccgtcgggcctggaggaagagctgaccctcaagtatggggcgaaacgtgtgatcatgctattcgtgcctgtcacgctgtgtatgatcgtggtggtggccactatcaagtctgtgcgtttctacactgagaagaacgggcagctcatctacacgcccttcacggaggacacgccctcggtgggccagcggctcctcaactccgtgcttaacaccctcatcatgatcagcgtcatcgtagtcatgaccatcttcctcgtggtactctacaagtatcgatgctacaagttcatccatggctggctgatcatgtcctccctgatgctcctcttcttgttcacctacatctacctcggggaagtgctcaagacctacaatgtggccatggactatcccacactcttcctggctgtctggaacttcggggcagtgggcatggtgtgcatccactggaaggggcctctagcgctgcagcaggcttaccttattgtgatcagcgcactcatggccctggtgttcatcaagtacctgccggagtggtctgcctgggtcatcttgggtgccatctctgtgtacgatctcgtggccgtgctgtgccccaaagggccactgaggatgctggtggaaactgcccaggagagaaatgagcccatatttcctgccctgatatactcatctgccatggtgtggacggtgggcatggcaaagctggacccctcctctcaaggagcgctgcagctcccctatgacccagagatggaagaagactcctacgacagttttggagaaccctcataccctgaagccttcgaagcccccctgcctggctacccaggggaggagctggaggaggaggaggaaaggggcgtgaagctcggcctgggagacttcatcttctacagcgtcctggtgggcaaggctgcagccactggcaacggagactggaacactacgctggcctgttttatcgccatcctcattggcttgtgtctcaccctcctgctgcttgctgtgttcaagaaggctctgcccgccctccccatctccatcacctttggactcatcttctacttctccacagacaacctggtgcgccctttcatggacactctggcctcccaccagctctacatctga

SEQ ID NO: 90 - protein, 448 aa, Mus musculus
MLAFMASDSEEEVCDERTSLMSAESPTSRSCQEGRPGPEDGESTAQWRTQESEEDCEEDPDRYACSGAPGRPSGLEEELTLKYGAKRVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLFLAVWNFGAVGMVCIHWKGPLALQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPLPGYPGEELEEEEERGVKLGLGDFIFYSVLVGKAAATGNGDWNTTLACFIAILIGLCLTLLLLAVFKKALPALPISITFGLIFYFSTDNLVRPFMDTLASHQLYI

SEQ ID NO: 91 - DNA, 1347 bp, Rattus norvegicus
  CDS (1)..(1344)
atgctcacattcatggcctctgatagcgaggaagaggtgtgcgatgagcggacgtccttgatgtcagccgagagccctacatcacgttcctgccaggacagcaggccaggcccagaggatggagagaacactgcccagtggaggagccaggagaacgaggacgactgtgaggaggacccggaccactatgcctgcagtggggttcctgggcgaccatcgggcctggaggaggagctgaccctcaagtatggggcgaagcacgtgatcatgctgttcgtgcctgtcacgctgtgcatgattgtggtggtggccaccatcaagtccgtgcgtttctacacggagaagaacgggcagctcatctacacgcccttcaccgaggacacaccctctgtgggccagcggctcctcaactccgtgctgaacactctgatcatgatcagcgtcattgtggtcatgactatcttcctagtggtactctacaaatatcgctgttacaagttcatccatggctggctgatcatgtcctccctgatgctcctcttcttgttcacctacatctacctcggggaagtgttcaagacctacaatgtggccatggactaccccacactgttcctggctgtctggaacttcggggcagtgggcatggtgtgcatccactggaagggtcccctggtgctccagcaggcttacctcattgtgatcagcgcactcatggccctggtgttcatcaagtacctgccggagtggtccgcttgggtcatcttgggcgccatctctgtgtacgatctcgtggctgtgctgtgccccaaagggccactgaggatgctggtggaaactgcccaggaaagaaacgagcccatatttcctgccctcatatactcatctgccatggtgtggacggtaggcatggcgaagctggacccctcctctcagggagcactgcagctcccttacgatccagagatggaagaagactcctatgacagttttggggaaccctcataccctgaagccttcgaagctccccagcctggctacccaggggaagagccggaggaggaggaggaaaggggtgtaaagcttggtctgggagacttcatcttctacagcgttctggtgggcaaggcagcagccacaggcaacggagactggagcacgacgctggcctgctttatcgccatcctcattggcttgtgtctcaccctcctgctgctcgccgtgttcaagaaggccctgcccgccctccccatctccatcaccttcgggctcatcttttacttctccacagacaacctggtgcgtcctttcatggacacgttggcctcccaccagctctacatctga

SEQ ID NO: 92 - protein, 448 aa, Rattus norvegicus
MLTFMASDSEEEVCDERTSLMSAESPTSRSCQDSRPGPEDGENTAQWRSQENEDDCEEDPDHYACSGVPGRPSGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVFKTYNVAMDYPTLFLAVWNFGAVGMVCIHWKGPLVLQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPQPGYPGEEPEEEEERGVKLGLGDFIFYSVLVGKAAATGNGDWSTTLACFIAILIGLCLTLLLLAVFKKALPALPISITFGLIFYFSTDNLVRPFMDTLASHQLYI

SEQ ID NO: 93 - DNA, 1347 bp, Homo sapiens
  CDS (1)..(1344)
atgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctga

SEQ ID NO: 94 - protein, 448 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 95 - DNA, 2127 bp, Mus musculus
  CDS (1)..(2124)
atggctacgactaggggcggctctgggcctgacccaggaagtcggggtcttcttcttctgtctttttccgtggtactggcaggattgtgtgggggaaactcagtggagaggaaaatctacattcccttaaataaaacagctccttgtgtccgcctgctcaacgccactcatcagattggctgccagtcttcaattagtggggatacaggggttatccacgtagtggagaaagaagaagacctgaagtgggtgttgaccgatggccccaaccccccttacatggttctgctggagggcaagctcttcaccagagatgtaatggagaagctgaagggaacaaccagtagaatcgctggtcttgccgtgactctagccaagcccaactcaacttcaagcttctctcctagtgtgcagtgcccaaatgatgggtttggtatttactccaactcctacgggccagagtttgctcactgcaagaaaacactgtggaatgaactgggcaacggcttggcttatgaagactttagtttccccatctttcttcttgaagatgagaacgaaaccaaggtcatcaagcagtgctatcaagatcacaacctgggtcagaatggctctgcaccaagcttcccattgtgtgctatgcagctcttctcacacatgcacgccgtcatcagcactgccacctgcatgcggcgcagcttcatccagagcaccttcagcatcaacccagaaatcgtctgtgaccccttatctgactacaacgtatggagcatgcttaagcctataaatacatctgtgggactagaacctgacgtcagggttgtggttgcggccacacggctggatagccggtcctttttctggaatgtggccccaggggctgaaagtgctgtagcctcctttgtcactcagctggctgcagctgaagctttgcacaaggcacctgatgtgaccactctatcccgaaatgtgatgtttgtcttcttccagggggaaacttttgactacattggcagctcacggatggtctatgatatggagaacggcaagtttcccgtgcggctcgagaacatcgactccttcgtggagctgggacaggtggccctaagaacttcactagatctctggatgcacacagatcccatgtctcagaaaaatgagtctgtgaaaaaccaggtggaggatcttctggccactctggagaagagcggtgctggtgtccctgaagttgtcctgaggagactggcccagtcccaggcccttccaccttcatctctacaacgatttcttcgggctcgaaacatctctggcgtggtcctggctgaccactctggctccttccacaatcggtattaccagagcatttatgacacggctgagaacattaatgtgacctatcctgagtggcagagcccagaagaggacctcaactttgtgacagacactgccaaggcactggcgaatgtggccacagtgctggcgcgtgcactgtatgagcttgcaggaggaaccaacttcagcagctccatccaggctgatccccagacagttacacgtctgctctatgggttcctggttaaagctaacaactcatggtttcagtcgatcctgaaacatgacctaaggtcctatttggatgacaggcctcttcaacactacatcgccgtctccagccctaccaacacgacttacgttgtgcagtacgccttggcaaacctgactggcaaggcgaccaacctcacccgagagcagtgccaggatccaagtaaagtcccaaatgagagcaaggatttatatgaatactcgtgggtacaaggcccttggaattccaacaggacagagaggctcccacagtgtgtgcgctccacagtgcgactggccagggccttgtcccctgcctttgaactgagtcagtggagctccacagaatactctacgtgggcggagagccgctggaaagacatccaagctcggatattcctaattgccagcaaagagcttgagttcatcacgctgatcgtgggcttcagcatccttatcttctctctcatcgtcacctactgcatcaatgccaaagccgacgtcctttttgttgctccccgagagccaggagctgtgtcttactga

SEQ ID NO: 96 - protein, 708 aa, Mus musculus
MATTRGGSGPDPGSRGLLLLSFSVVLAGLCGGNSVERKIYIPLNKTAPCVRLLNATHQIGCQSSISGDTGVIHVVEKEEDLKWVLTDGPNPPYMVLLEGKLFTRDVMEKLKGTTSRIAGLAVTLAKPNSTSSFSPSVQCPNDGFGIYSNSYGPEFAHCKKTLWNELGNGLAYEDFSFPIFLLEDENETKVIKQCYQDHNLGQNGSAPSFPLCAMQLFSHMHAVISTATCMRRSFIQSTFSINPEIVCDPLSDYNVWSMLKPINTSVGLEPDVRVVVAATRLDSRSFFWNVAPGAESAVASFVTQLAAAEALHKAPDVTTLSRNVMFVFFQGETFDYIGSSRMVYDMENGKFPVRLENIDSFVELGQVALRTSLDLWMHTDPMSQKNESVKNQVEDLLATLEKSGAGVPEVVLRRLAQSQALPPSSLQRFLRARNISGVVLADHSGSFHNRYYQSIYDTAENINVTYPEWQSPEEDLNFVTDTAKALANVATVLARALYELAGGTNFSSSIQADPQTVTRLLYGFLVKANNSWFQSILKHDLRSYLDDRPLQHYIAVSSPTNTTYVVQYALANLTGKATNLTREQCQDPSKVPNESKDLYEYSWVQGPWNSNRTERLPQCVRSTVRLARALSPAFELSQWSSTEYSTWAESRWKDIQARIFLIASKELEFITLIVGFSILIFSLIVTYCINAKADVLFVAPREPGAVSY

SEQ ID NO: 97 - DNA, 2127 bp, Rattus norvegicus
  CDS (1)..(2124)
atggctacggctaggggcggctctgggcctgacccaggaagtcggggtctccttcttctgtctttttccgtggtactagcaggattgtgtgggggaaactcagtggagaggaagatctacattcccttaaataaaacagctccttgtgtccgcctgctcaatgccactcatcagattggctgccagtcttcaattagtggggatacaggggttatccacgtagtggagaaagaagacgacctgaaatgggtattgacggatggccccaaccccccttacatggttctgctggagggcaagctctttaccagagatataatggaaaagctgaagggggaaaccagtagaatcgctggtcttgccgtgactctagccaagcccaattcaacgtcaagcttctctcctagcgtgcagtgcccaaatgatgggtttggtatttactccaactcctatgggccagagtttgctcactgcaaaaaaacattgtggaatgaactgggcaatggcttggcttatgacgacttcagtttccccatctttcttcttgaagatgagaacgaaaccaaggtcatcaagcagtgctatcaagatcacaacctgggtcagaatggctctgcaccgagcttcccactgtgtgctatgcagctcttctcacacatgcacgccgtcatcagcaccgccacctgcatgcgacgcagcttcatccagagcaccttcagcatcaacccagaaatcgtctgtgaccccttatccgactacaacgtatggagcatgcttaagcctataaatacgtctgggggattagaacctgatgtcagggttgtggttgcagccacacggctggatagccggtccttcttctggaatgtggccccaggggcagaaagtgccgttgcctcctttgtcactcagctggccgcagctgaagctttgcacaaggcacctgatgtgaccaccctaccccgaaatgtgatgtttgtcttcttccagggggaaacttttgactacattggcagctcaaggatggtctatgacatggagaacggcaagtttcctgtgcggctagagaacattgactcctttgtggagctggggcaggtggccctaaggacgtcactagaactctggatgcacacagatcctatgtctcagaaaaatgaatctgtgaagaaccaggtggaggatcttctggtcactctggagcagagtggtgctgatacccctcaagttgtcctgagcagactagtccagtcccaggcccttccaccatcatctctacaacgatttcttcgggctcgaaacatctctggtgtggtcttggctgaccactctggttccttccacaatcggtattaccagagcatttatgacactgctgagaacattaacgtgacctatcctgagtcgcagagcccagaagaggacctcaactttgtaacagacactgccaaggcactggcagatgttgccacagtgctggcacgagctttgtacaagcttgcaggaggaaccaacttcaacaactccattcaggctgatccccagacagttacacgtctgctctatgggttcctggtcagagctaacaactcatggtttcagtctatcctcagacatgatctgaggtcctatttggatgatgggcctcttcaacactacatcgctgtctccagccctaccaacacgacttacgttgtgcagtatgccttggcaaacctgactggcaaggtgaccaacctcacccaagagcagtgccaggatccaagtaaagtcccaaatgaaagcaaggatttgtatgaatactcgtgggtacaaggcccttggaattccaacaagacagagcggctcccacggtgtgtgcgctccacagtacgactggctagggccttgtcccccgcctttgagctgagtcagtggagctccacagaatactctacgtgggccgagagccgctggaaagatatccaagctcggatattcctcattgccagcaaagaacttgagttcatcacgctgatcgtgggcttcagcatcctcgtcttttctctcatcgtcacttattgtatcaacgccaaggccgatgtccttttcgttgctccccgagagccaggagctgtgtcttactga

SEQ ID NO: 98 - protein, 708 aa, Rattus norvegicus
MATARGGSGPDPGSRGLLLLSFSVVLAGLCGGNSVERKIYIPLNKTAPCVRLLNATHQIGCQSSISGDTGVIHVVEKEDDLKWVLTDGPNPPYMVLLEGKLFTRDIMEKLKGETSRIAGLAVTLAKPNSTSSFSPSVQCPNDGFGIYSNSYGPEFAHCKKTLWNELGNGLAYDDFSFPIFLLEDENETKVIKQCYQDHNLGQNGSAPSFPLCAMQLFSHMHAVISTATCMRRSFIQSTFSINPEIVCDPLSDYNVWSMLKPINTSGGLEPDVRVVVAATRLDSRSFFWNVAPGAESAVASFVTQLAAAEALHKAPDVTTLPRNVMFVFFQGETFDYIGSSRMVYDMENGKFPVRLENIDSFVELGQVALRTSLELWMHTDPMSQKNESVKNQVEDLLVTLEQSGADTPQVVLSRLVQSQALPPSSLQRFLRARNISGVVLADHSGSFHNRYYQSIYDTAENINVTYPESQSPEEDLNFVTDTAKALADVATVLARALYKLAGGTNFNNSIQADPQTVTRLLYGFLVRANNSWFQSILRHDLRSYLDDGPLQHYIAVSSPTNTTYVVQYALANLTGKVTNLTQEQCQDPSKVPNESKDLYEYSWVQGPWNSNKTERLPRCVRSTVRLARALSPAFELSQWSSTEYSTWAESRWKDIQARIFLIASKELEFITLIVGFSILVFSLIVTYCINAKADVLFVAPREPGAVSY

SEQ ID NO: 99 - DNA, 2130 bp, Homo sapiens
  CDS (1)..(2127)
atggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactga

SEQ ID NO: 100 - protein, 709 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 101 - DNA, 744 bp, Mus musculus
  CDS (1)..(741)
atgggggctgctgtgtttttcggatgcaccttcgtcgcgttcggcccagccttctcccttttcctgatcactgtagctggagacccacttcgggttatcatcctggtggcgggagcctttttctggctggtctccctgctcttggcttctgtggtctggttcatcttggtccatgtgacagaccgatcagatgcacggctccagtatggcctcctgatttttggtgctgctgtctctgtccttctacaggaagtgttccgttttgcttactacaagctccttaagaaggcagatgagggcttagcatcactgagtgaggacggaagatcacccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcctttctgacagcagccattatcctgctccacaccttttggggagttgtgttctttgatgcctgtgagaggagacggtactgggctttgggcctggtagttgggagtcaccttctgacatcgggactgacattcctgaacccctggtatgaggctagcctgctgcccatctatgcagtcaccgtttccatggggctctgggcgttcatcacagccggaggctccctccgaagtatccagcgcagcctttcgtgtaaggactga

SEQ ID NO: 102 - protein, 247 aa, Mus musculus
MGAAVFFGCTFVAFGPAFSLFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLSCKD

SEQ ID NO: 103 - DNA, 744 bp, Rattus norvegicus
  CDS (1)..(741)
atgggggctgctgtgtttttcggatgcaccttcgtcgcgttcggcccagccttcgcccttttcctgattactgtagccggagaccctcttcgggttatcatcctggtggcgggagcctttttctggctggtttccctgctcttggcctctgtggtctggttcatcttggtccatgtgacagaccgatcagatgcacggctccagtatggcctcctgatttttggtgctgctgtctctgtccttctacaggaagtgttccgttttgcctactacaagctccttaagaaggcagatgagggcttagcatcactaagtgaggacggaagatcgcccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcttttctgacagcagccattatcctgctccataccttttggggagttgtgttctttgatgcctgtgagaggagacggtactgggctttgggcctggtagttgggagtcaccttctgacttcaggactgacattcctgaacccctggtatgaggccagcctgctgcccatctatgcagtcaccgtttccatggggctctgggcattcgtcacagccggaggctccctccggagtatccagcgcagcctttcgtgtaaggactga

SEQ ID NO: 104 - protein, 247 aa, Rattus norvegicus
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFVTAGGSLRSIQRSLSCKD

SEQ ID NO: 105 - DNA, 744 bp, Homo sapiens
  CDS (1)..(741)
atgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactga

SEQ ID NO: 106 - protein, 247 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 107 - DNA, 306 bp, Mus musculus
  CDS (1)..(303)
atgaacttggagcgggtatccaatgaggagaagttgaacctgtgccggaagtactatcttggtggatttgcgttcctgccttttctttggttagtcaacattttctggttcttcagagaggcgttcctcgccccagcctacacagagcagagccaaatcaaaggctatgtttggcgctcagctgtgggcttcctcttctgggtgatcattctcgccacctggatcaccatcttccagatctaccggccccgctggggcgctcttggggactacctctccttcaccattcccctgggcactccctaa

SEQ ID NO: 108 - protein, 101 aa, Mus musculus
MNLERVSNEEKLNLCRKYYLGGFAFLPFLWLVNIFWFFREAFLAPAYTEQSQIKGYVWRSAVGFLFWVIILATWITIFQIYRPRWGALGDYLSFTIPLGTP

SEQ ID NO: 109 - DNA, 306 bp, Rattus norvegicus
  CDS (1)..(303)
atgaacttagagcgggtgtccaatgaggagaagttgaacctgtgccggaagtactatcttggtggatttgcatttctgccttttctttggttggtcaacattttctggttcttcaaagaggccttcttcgctccagcctacacagagcagagccaaatcaaaggctatgtttggcgctcagctgtgggcttcctcttctgggtgattgttctcaccacctggatcaccatcttccagatctaccggccccgctggggtgctcttggggactacctctccttcaccattcccctgggcactccctga

SEQ ID NO: 110 - protein, 101 aa, Rattus norvegicus
MNLERVSNEEKLNLCRKYYLGGFAFLPFLWLVNIFWFFKEAFFAPAYTEQSQIKGYVWRSAVGFLFWVIVLTTWITIFQIYRPRWGALGDYLSFTIPLGTP

SEQ ID NO: 111 - DNA, 306 bp, Homo sapiens
  CDS (1)..(303)
atgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctga

SEQ ID NO: 112 - protein, 101 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

The invention claimed is:

1. A method for screening a substance that affects gelatinase-mediated EphA4 processing, which comprises the steps of:
   (a) allowing a first biological composition containing gelatinase or a biologically active fragment thereof to be contacted with a second biological composition containing EphA4 in the presence and absence of a candidate substance, wherein the gelatinase is MMP-2 or MMP-9;
   (b) measuring the presence or amount of the EphA4 ectodomain and/or endodomain fragment; and
   (c) selecting the candidate substance as a substance that affects gelatinase-mediated EphA4 processing if the results of the step (b) measured in the presence of the candidate substance are changed in comparison with the results of the step (b) measured in the absence of the candidate substance.

2. The method according to claim 1, wherein the step (c) comprises identifying the candidate substance as a substance that promotes gelatinase-mediated EphA4 processing if the EphA4 endodomain and/or ectodomain fragment measured in the presence of the candidate substance during the step (b) is increased in comparison with the EphA4 endodomain and/or ectodomain fragment measured in the absence of the candidate substance during the step (b).

3. The method according to claim 1, wherein the step (c) comprises identifying the candidate substance as a substance that inhibits gelatinase-mediated EphA4 processing if the EphA4 endodomain and/or ectodomain fragment measured in the presence of the candidate substance during the step (b) is decreased in comparison with the EphA4 endodomain and/or ectodomain fragment measured in the absence of the candidate substance during the step (b).

4. The method according to claim 2, wherein the substance that promotes gelatinase-mediated EphA4 processing is further evaluated as a substance that promotes γ-secretase-mediated EphA4 cleavage reaction.

5. The method according to claim 3, wherein the substance that inhibits gelatinase-mediated EphA4 processing is further evaluated as a substance that inhibits γ-secretase-mediated EphA4 cleavage reaction.

6. The method according to claim 2, wherein the substance that promotes gelatinase-mediated EphA4 processing is further evaluated as a substance that promotes spine formation reaction mediated by the EphA4 intracellular fragment.

7. The method according to claim 3, wherein the substance that inhibits gelatinase-mediated EphA4 processing is further evaluated as a substance that inhibits spine formation reaction mediated by the EphA4 intracellular fragment.

8. The method according to claim 1, wherein the gelatinase is MMP-2.

9. The method according to claim 1, wherein the gelatinase is MMP-9.

* * * * *